United States Patent
Li et al.

(10) Patent No.: US 12,365,899 B2
(45) Date of Patent: *Jul. 22, 2025

(54) RNAi AGENTS AND COMPOSITIONS FOR INHIBITING EXPRESSION OF APOLIPOPROTEIN C-III (APOC3)

(71) Applicant: Arrowhead Pharmaceuticals, Inc., Pasadena, CA (US)

(72) Inventors: Zhen Li, San Diego, CA (US); Rui Zhu, San Diego, CA (US); Tao Pei, Middleton, WI (US); Steven Kanner, Berkeley, CA (US); So Wong, Oregon, WI (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 249 days.

This patent is subject to a terminal disclaimer.

(21) Appl. No.: 18/145,218

(22) Filed: Dec. 22, 2022

(65) Prior Publication Data

US 2023/0323350 A1   Oct. 12, 2023

Related U.S. Application Data

(62) Division of application No. 17/815,799, filed on Jul. 28, 2022, now abandoned, which is a division of application No. 17/699,653, filed on Mar. 21, 2022, now abandoned, which is a division of application No. 17/529,364, filed on Nov. 18, 2021, now abandoned, which is a division of application No. 16/778,188, filed on Jan. 31, 2020, now Pat. No. 11,214,801, which is a division of application No. 16/126,740, filed on Sep. 10, 2018, now Pat. No. 10,597,657.

(60) Provisional application No. 62/720,434, filed on Aug. 21, 2018, provisional application No. 62/643,927, filed on Mar. 16, 2018, provisional application No. 62/556,818, filed on Sep. 11, 2017.

(51) Int. Cl.

| | |
|---|---|
| *C12N 15/113* | (2010.01) |
| *A61K 9/00* | (2006.01) |
| *A61P 1/18* | (2006.01) |
| *A61P 3/04* | (2006.01) |
| *A61P 9/10* | (2006.01) |
| *C07H 3/02* | (2006.01) |

(52) U.S. Cl.
CPC ............. *C12N 15/113* (2013.01); *A61P 1/18* (2018.01); *A61P 3/04* (2018.01); *A61P 9/10* (2018.01); *C07H 3/02* (2013.01); *A61K 9/0019* (2013.01); *C12N 2310/11* (2013.01); *C12N 2310/14* (2013.01); *C12N 2310/315* (2013.01); *C12N 2310/317* (2013.01); *C12N 2310/321* (2013.01); *C12N 2310/322* (2013.01); *C12N 2310/3233* (2013.01); *C12N 2310/332* (2013.01); *C12N 2310/343* (2013.01); *C12N 2310/346* (2013.01); *C12N 2310/351* (2013.01)

(58) Field of Classification Search
None
See application file for complete search history.

(56) References Cited

U.S. PATENT DOCUMENTS

| | | | |
|---|---|---|---|
| 10,597,657 B2 * | 3/2020 | Li | ............................ A61P 3/04 |
| 11,214,801 B2 * | 1/2022 | Li | ............................ A61P 1/18 |

FOREIGN PATENT DOCUMENTS

| | | | | |
|---|---|---|---|---|
| WO | WO-2014205451 A2 * | 12/2014 | ......... | A61K 31/7125 |

* cited by examiner

*Primary Examiner* — Brian Whiteman
(74) *Attorney, Agent, or Firm* — Mitchell Porter; Paul VanderVelde; Meibo Chen

(57) ABSTRACT

The present disclosure relates to RNAi agents, e.g., double stranded RNAi agents, capable of inhibiting Apolipoprotein C-III (also called APOC3, apoC-III, APOC-III, and APO C-III) gene expression, and compositions that include APOC3 RNAi agents. The APOC3 RNAi agents disclosed herein may be conjugated to targeting ligands, including ligands that include N-acetyl-galactosamine, to facilitate the delivery to cells, including to hepatocytes. Pharmaceutical compositions that include one or more APOC3 RNAi agents, optionally with one or more additional therapeutics, are also described. Delivery of the APOC3 RNAi agents in vivo provides for inhibition of APOC3 gene expression, and can result in lower triglycerides and/or cholesterol levels in the subject. The APOC3 RNAi agents can be used in methods of treatment of APOC3-related diseases and disorders, including hypertriglyceridemia, cardiovascular disease, and other metabolic-related disorders and diseases.

22 Claims, 27 Drawing Sheets

Specification includes a Sequence Listing.

FIG. 1D
FIG. 1E
FIG. 1F

RNAi AGENTS AND COMPOSITIONS FOR INHIBITING EXPRESSION OF APOLIPOPROTEIN C-III (APOC3)

CROSS REFERENCE TO RELATED APPLICATIONS

This application is a divisional of U.S. patent application Ser. No. 17/815,799, filed Jul. 28, 2022, which is a divisional of U.S. patent application Ser. No. 17/699,653, filed Mar. 21, 2022, which is a divisional of U.S. patent application Ser. No. 17/529,364, filed Nov. 18, 2021, which is a divisional of U.S. patent application Ser. No. 16/778,188, filed Jan. 31, 2020, now U.S. patent Ser. No. 11/214,801, which is a divisional of U.S. patent application Ser. No. 16/126,740, filed Sep. 10, 2018, now U.S. patent Ser. No. 10/597,657, which claims priority from U.S. Provisional Patent Application Ser. No. 62/720,434, filed on Aug. 21, 2018, U.S. Provisional Patent Application Ser. No. 62/643,927, filed on Mar. 16, 2018, and U.S. Provisional Patent Application Ser. No. 62/556,818, filed on Sep. 11, 2017, the contents of each of which are incorporated herein by reference in their entirety.

SEQUENCE LISTING

This application contains a Sequence Listing which has been submitted in XML format and is hereby incorporated by reference in its entirety. The XML copy is named 30655-US6_ST26.xml, created Dec. 21, 2022, and is 4,828 kb in size.

FIELD OF THE INVENTION

The present disclosure relates to RNA interference (RNAi) agents, e.g., double stranded RNAi agents, for inhibition of apolipoprotein C-III gene expression, compositions that include apolipoprotein C-III RNAi agents, and methods of use thereof.

BACKGROUND

Apolipoprotein C-III (also called APOC3, apoC-III, APOC-III, and APO C-III), encoded by the human Apolipoprotein C-III gene, has recently emerged as a promising target for the treatment of diseases associated with hypertriglyceridemia. Elevated serum triglyceride (TG) levels have been identified as an independent risk factor for cardiovascular disease, and as a contributing factor in the development of atherosclerosis. Individuals with severe hypertriglyceridemia (often >1000 mg/dL) are also at risk of recurrent pancreatitis. Triglycerides are primarily transported in the blood as a major component of very low density lipoprotein (VLDL) and chylomicron particles, which are known as TG-rich lipoproteins. Lipoproteins are composed of a hydrophobic triacylglycerol and cholesteryl ester core, and a hydrophilic outer layer of phospholipids, cholesterol, and apoproteins. APOC3 is one of these apoproteins.

APOC3 is primarily synthesized in the liver and plays an important role in the production, metabolism, and clearance of TG-rich lipoproteins from plasma. Several gain-of-function polymorphisms have been identified in the promoter region of the APOC3 gene, which are postulated to be contributing factors in development of hypertriglyceridemia (See, e.g., Wang, Y., et al., Association of Apolipoprotein C3 Genetic Polymorphisms with the Risk of Ischemic Stroke in the Northern Chinese Han Population, 11 *PLoS One* e0163910 (2016); Li, Y., et al., Apolipoprotein C3 gene variants and the risk of coronary heart disease: A meta-analysis 9*Meta Gene* 104-109 (2016)). Increased APOC3 synthesis in the liver promotes secretion of TG-rich VLDL. In addition, over-abundance of APOC3 inhibits the activity of lipoprotein lipase and hepatic lipase, further increasing serum TG levels by delaying the catabolism of TG-rich lipoproteins. Furthermore, elevated APOC3 also delays the hepatic clearance of TG-rich lipoprotein and their remnant particles by interfering with their binding to hepatic receptors. Several large genetic analysis studies have reported that individuals with loss-of-function mutations of APOC3 exhibit low levels of triglyceride and reduced incidence of cardiovascular disease. (See, e.g., Bernelot Moens, S. J., et al., Inhibition of ApoCIII: the next PCSK9? 25 *Curr Opin Lipidol* 418-422 (2014); Saleheen, D., et al., Human knockouts and phenotypic analysis in a cohort with a high rate of consanguinity, 544 *Nature* 235-239 (2017)).

Currently, hypertriglyceridemia is often treated with fibrates or in combination with statins in moderate cases; however, in most cases, the reduction in serum TG is modest. Additionally, available therapeutics are often ineffective in patients with monogenic causes of very severe hypertriglyceridemia (such as patients with familial chylomicronemia syndrome) because the disease-causing mutations lead to dysfunctional lipoprotein lipase and functional lipoprotein lipase is required for optimal response to standard therapies. There is a need for an effective therapeutic that can provide a substantial TG lowering effect for the treatment of diseases where APOC3 may play a role, such as hypertriglyceridemia induced pancreatitis, metabolic syndrome, type II diabetes mellitus, familial chylomicronemia syndrome, familial partial lipodystrophy, obesity, hyperlipidemia, hypertriglyceridemia, abnormal lipid and/or cholesterol metabolism, atherosclerosis, cardiovascular disease, coronary artery disease, and other metabolic-related disorders and diseases. Certain other APOC3-specific RNA interference (RNAi) agents have been shown to inhibit expression of APOC3 gene expression, for example, in International Patent Application Publication No. WO 2016/011123 A1, to Weiler et al., which is incorporated herein by reference in its entirety. The APOC3 RNAi agents disclosed herein, however, were not previously disclosed or known and provide for highly potent and efficient inhibition of the expression of an APOC3 gene.

SUMMARY

There exists a need for novel APOC3 RNA interference (RNAi) agents (also herein termed RNAi agent, RNAi trigger, or trigger) that are able to selectively and efficiently inhibit the expression of an APOC3 gene. Further, there exists a need for compositions that include novel APOC3-specific RNAi agents for the treatment of diseases associated with, among other things, elevated triglyceride (TG) levels.

In general, the present disclosure features APOC3 gene-specific RNAi agents, compositions that include APOC3 RNAi agents, and methods for inhibiting expression of an APOC3 gene in vitro and/or in vivo using the APOC3 RNAi agents and compositions that include APOC3 RNAi agents described herein. The APOC3 RNAi agents disclosed herein can selectively and efficiently decrease or inhibit expression of an APOC3 gene, and thereby reduce TG levels and/or cholesterol levels in a subject, e.g., a human or animal subject.

The described APOC3 RNAi agents can be used in methods for therapeutic treatment (including the prophylactic and preventative treatment) of symptoms and diseases associated with elevated TG levels and/or elevated cholesterol levels, including, but not limited to, obesity, hyperlipidemia, hypertriglyceridemia, abnormal lipid and/or cholesterol metabolism, atherosclerosis, cardiovascular disease, coronary artery disease, hypertriglyceridemia induced pancreatitis, metabolic syndrome, type II diabetes mellitus, familial chylomicronemia syndrome, familial partial lipodystrophy, and other metabolic-related disorders and diseases. The APOC3 RNAi agents disclosed herein can selectively reduce APOC3 gene expression, which can lead to a reduction in, among other things, TG levels and/or cholesterol levels, in a subject. The methods disclosed herein include the administration of one or more APOC3 RNAi agents to a subject, e.g., a human or animal subject, using any suitable methods known in the art, such as subcutaneous injection or intravenous administration.

In one aspect, the disclosure features RNAi agents for inhibiting expression of the human APOC3 gene, wherein the RNAi agent includes a sense strand and an antisense strand. Also described herein are compositions that include or consist of an RNAi agent capable of inhibiting the expression of an APOC3 gene, wherein the APOC3 RNAi agent includes or consists of a sense strand and an antisense strand, and the composition further includes at least one pharmaceutically acceptable excipient. The compositions described herein that include one or more of the disclosed APOC3 RNAi agents are able to selectively and efficiently decrease expression of an APOC3 gene. The compositions that include one or more APOC3 RNAi agents can be administered to a subject, such as a human or animal subject, for the treatment (including prophylactic treatment or inhibition) of symptoms and diseases associated with elevated TG levels, elevated cholesterol, and/or enhanced APOC3 expression.

An APOC3 RNAi agent described herein includes a sense strand (also referred to as a passenger strand), and an antisense strand (also referred to as a guide strand). The sense strand and the antisense strand can be partially, substantially, or fully complementary to each other. The length of the RNAi agent sense and antisense strands described herein each can be 16 to 30 nucleotides in length. In some embodiments, the sense and antisense strands are independently 17 to 26 nucleotides in length. The sense and antisense strands can be either the same length or different lengths. In some embodiments, the sense and antisense strands are independently 21 to 26 nucleotides in length. In some embodiments, the sense and antisense strands are independently 21 to 24 nucleotides in length. In some embodiments, both the sense strand and the antisense strand are 21 nucleotides in length. In some embodiments, the sense and/or antisense strands are independently 16, 17, 18, 19, 20, 21, 22, 23, 24, 25, 26, 27, 28, 29, or 30 nucleotides in length. The RNAi agents described herein, upon delivery to a cell expressing APOC3, inhibit the expression of one or more APOC3 genes in vivo or in vitro.

A sense strand of the APOC3 RNAi agents described herein includes at least 16 consecutive nucleotides that have at least 85% identity to a core stretch sequence (also referred to herein as a "core stretch" or "core sequence") of the same number of nucleotides in an APOC3 mRNA. In some embodiments, the sense strand core stretch having at least 85% identity to a sequence in an APOC3 mRNA is 16, 17, 18, 19, 20, 21, 22, or 23 nucleotides in length. In some embodiments, the sense strand core stretch having at least 85% identity to a sequence in an APOC3 mRNA is 19 nucleotides in length. In some embodiments, this sense strand core stretch is 17 nucleotides in length.

An antisense strand of an APOC3 RNAi agent includes at least 16 consecutive nucleotides that have at least 85% complementarity to a core stretch of the same number of nucleotides in an APOC3 mRNA and to a core stretch of the same number of nucleotides in the corresponding sense strand. In some embodiments, the antisense strand core stretch having at least 85% complementarity to a sequence in an APOC3 mRNA or the corresponding sense strand is 16, 17, 18, 19, 20, 21, 22, or 23 nucleotides in length. In some embodiments, this antisense strand core stretch is 19 nucleotides in length. In some embodiments, this antisense strand core stretch is 17 nucleotides in length.

In some embodiments, the APOC3 RNAi agents disclosed herein target the portion of an APOC3 gene having the sequence of any of the sequences disclosed in Table 1.

Examples of APOC3 RNAi agent sense strands and antisense strands that can be included in the APOC3 RNAi agents disclosed herein are provided in Tables 3, 4, and 5. Examples of APOC3 RNAi agent duplexes are provided in Tables 3 and 6. Examples of 19-nucleotide core stretch sequences that that consist of or are included in the sense strands and antisense strands of APOC3 RNAi agents disclosed herein, are provided in Table 2.

In another aspect, the disclosure features methods for delivering APOC3 RNAi agents to liver cells in a subject, such as a mammal, in vivo. Also described herein are compositions for use in such methods. The one or more APOC3 RNAi agents can be delivered to target cells or tissues using any oligonucleotide delivery technology known in the art. Nucleic acid delivery methods include, but are not limited to, by encapsulation in liposomes, by iontophoresis, or by incorporation into other vehicles, such as hydrogels, cyclodextrins, biodegradable nanocapsules, and bioadhesive microspheres, proteinaceous vectors, or Dynamic Polyconjugates™ (DPCs) (see, for example WO 2000/053722, WO 2008/0022309, WO 2011/104169, and WO 2012/083185, each of which is incorporated herein by reference).

In some embodiments, an APOC3 RNAi agent is delivered to target cells or tissues by covalently linking or conjugating the RNAi agent to a targeting group, such as an asialoglycoprotein receptor ligand. In some embodiments, an asialoglycoprotein receptor ligand includes, consists of, or consists essentially of, a galactose or galactose derivative cluster. In some embodiments, an APOC3 RNAi agent is linked to a targeting ligand comprising the galactose derivative N-acetyl-galactosamine. In some embodiments, a galactose derivative cluster includes an N-acetyl-galactosamine trimer or an N-acetyl-galactosamine tetramer. In some embodiments, a galactose derivative cluster is an N-acetyl-galactosamine trimer or an N-acetyl-galactosamine tetramer. In some embodiments, the APOC3 RNAi agents that are conjugated to targeting ligands that include N-acetyl-galactosamine are selectively internalized by liver cells, and hepatocytes in particular, either through receptor-mediated endocytosis or by other means. Example targeting groups useful for delivering RNAi agents are disclosed, for example, in International Patent Application Publication Nos. WO 2018/044350 and WO 2017/156012, which are incorporated herein by reference in their entirety.

A targeting group can be linked to the 3' or 5' end of a sense strand or an antisense strand of an APOC3 RNAi agent. In some embodiments, a targeting group is linked to the 3' or 5' end of the sense strand. In some embodiments, a targeting group is linked to the 5' end of the sense strand. In some embodiments, a targeting group is linked internally to a nucleotide on the sense strand and/or the antisense strand of the RNAi agent. In some embodiments, a targeting group is linked to the RNAi agent via a linker.

A targeting group, with or without a linker, can be linked to the 5' or 3' end of any of the sense and/or antisense strands disclosed in Tables 2, 3, 4 and 5. A linker, with or without a targeting group, can be attached to the 5' or 3' end of any of the sense and/or antisense strands disclosed in Tables 2, 3, 4 and 5.

In some embodiments, described herein are compositions that include one or more APOC3 RNAi agents having the duplex sequences disclosed in Table 6.

In a further aspect, described herein are pharmaceutical compositions that include one or more described APOC3 RNAi agent(s), optionally combined with one or more additional (i.e., second, third, etc.) therapeutics. In some embodiments, the pharmaceutical compositions that include one or more described APOC3 RNAi agent(s), optionally combined with one or more additional (i.e., second, third, etc.) therapeutics, can be formulated in a pharmaceutically acceptable carrier or diluent. In some embodiments, these compositions can be administered to a subject, such as a mammal. In some embodiments, the mammal is a human.

In some embodiments, the compositions described herein include a combination or cocktail of at least two APOC3 RNAi agents having different nucleotide sequences. In some embodiments, the two or more different APOC3 RNAi agents are each separately and independently linked to targeting groups. In some embodiments, the two or more different APOC3 RNAi agents are each linked to targeting groups that include or consist of targeting ligands that include one or more moieties that target the asialoglycoprotein receptor. In some embodiments, the two or more different APOC3 RNAi agents are each linked to targeting groups that include or consist of targeting ligands that include one or more galactose derivatives. In some embodiments, the two or more different APOC3 RNAi agents are each linked to targeting groups that include or consist of targeting ligands that include one or more N-acetyl-galactosamines.

In another aspect, the disclosure features methods for inhibiting APOC3 gene expression in a subject, wherein the methods include administering to a subject or to a cell of a subject an amount of an APOC3 RNAi agent capable of inhibiting the expression of an APOC3 gene, wherein the APOC3 RNAi agent comprises a sense strand and an antisense strand, and wherein the antisense strand includes the sequence of any one of the antisense strand nucleotide sequences in Table 2, Table 3, or Table 4. In some embodiments, compositions for delivering an APOC3 RNAi agent to a liver cell, particularly hepatocytes, in vivo are described, the compositions comprising: an APOC3 RNAi agent conjugated to a targeting group. In some embodiments, the targeting group is an asialoglycoprotein receptor ligand.

In some embodiments, disclosed herein are methods of inhibiting expression of an APOC3 gene, wherein the methods include administering to a subject or to a cell of a subject an amount of an APOC3 RNAi agent capable of inhibiting the expression of an APOC3 gene, wherein the APOC3 RNAi agent comprises a sense strand and an antisense strand, and wherein the sense strand includes the sequence of any one of the sense strand nucleotide sequences in Table 2, Table 3, or Table 5. Also described herein are compositions for use in such methods.

In a further aspect, the disclosure features methods of treatment (including preventative or prophylactic treatment) of diseases or symptoms caused by elevated TG levels and/or elevated cholesterol levels, wherein the methods include administering to a subject in need thereof an APOC3 RNAi agent having an antisense strand that includes the sequence of any of the sequences in Tables 2, 3, or 4. In some embodiments, described herein are methods of treatment (including preventative or prophylactic treatment) of diseases or symptoms caused by elevated TG levels and/or elevated cholesterol levels, wherein the methods include administering to a subject in need thereof an APOC3 RNAi agent having a sense strand comprising the sequence of any of the sequences in Tables 2, 3, or 5. Also described herein are compositions for use in such methods.

Also described are methods of treating a human subject having a pathological state (such as a condition or disease), or being at risk of developing a pathological state, that is mediated at least in part by APOC3 gene expression, the methods comprising the step of administering to the subject a therapeutically effective amount of an APOC3 RNAi agent and/or APOC3 RNAi agent-containing composition. The method of treating a subject with an APOC3 RNAi agent and/or APOC3 RNAi agent-containing composition can optionally be combined with one or more steps of administering one or more additional (i.e., second, third, etc.) therapeutics or treatments. The APOC3 RNAi agent and additional therapeutics can be administered in a single composition or they can be administered separately. An additional therapeutic can be another APOC3 RNAi agent (e.g., an APOC3 RNAi agent that targets a different sequence within the APOC3 gene). An additional therapeutic can also be a small molecule drug, antibody, antibody fragment, and/or aptamer. In some embodiments, the one or more additional therapeutics is a statin, such as atorvastatin, fluvastatin, pravastatin, pitavastatin, rosuvastatin, or simvastatin.

In some embodiments, the described APOC3 RNAi agent(s) are optionally combined with one or more additional therapeutics, wherein the one or more additional therapeutics is administered separately in separate dosage forms from the RNAi agent (e.g., the APOC3 RNAi agent is administered by subcutaneous injection, while the additional therapeutic involved in the method of treatment dosing regimen is administered orally). In some embodiments, the described APOC3 RNAi agent(s) are administered to a subject in need thereof via subcutaneous injection, and the one or more optional additional therapeutics are administered orally, which together provide for a treatment regimen for diseases and conditions associated with elevated TG and/or cholesterol levels. In some embodiments, the described APOC3 RNAi agent(s) are administered to a subject in need thereof via subcutaneous injection, and the one or more optional additional therapeutics are administered via a separate subcutaneous injection. In some embodiments, the APOC3 RNAi agent and one or more additional therapeutics are combined into a single dosage form (e.g., a "cocktail" formulated into a single composition for subcutaneous injection). The APOC3 RNAi agents, with or without the one or more additional therapeutics, can be combined with one or more excipients to form pharmaceutical compositions.

In some embodiments, disclosed herein are methods for inhibiting expression of an APOC3 gene, the methods include administering to the cell or subject an APOC3 RNAi agent that includes a sense strand comprising, consisting of, or consisting essentially of the sequence of any of the sequences in Tables 2, 3, or 5. In some embodiments, disclosed herein are methods of inhibiting expression of an APOC3 gene, wherein the methods include administering an APOC3 RNAi agent that includes a sense strand comprising the sequence of any of the sequences in Table 5, and the antisense strand comprising, consisting of, or consisting essentially of the sequence of any of the sequences in Table 4.

In some embodiments, disclosed herein are methods of inhibiting expression of an APOC3 gene in a cell or a subject, wherein the methods include administering to the cell or subject an APOC3 RNAi agent that includes a sense strand that includes the nucleobase sequence of any of the sequences in Table 5, and an antisense strand that includes the nucleobase sequence of any of the sequences in Table 4. In other embodiments, disclosed herein are methods of inhibiting expression of an APOC3 gene, wherein the methods include administering to a subject an APOC3 RNAi agent that includes a sense strand consisting of the modified sequence of any of the modified sequences in Table 5, and the antisense strand consisting of the modified sequence of any of the modified sequences in Table 4.

In some embodiments, compositions for delivering an APOC3 RNAi agent to a liver cell, particularly hepatocytes, in vivo, are described, the compositions comprising: an APOC3 RNAi agent conjugated to a targeting group. In some embodiments, the targeting group is an asialoglycoprotein receptor ligand (i.e., a ligand that includes a compound having affinity for the asialoglycoprotein receptor). In some embodiments, the targeting group comprises N-acetyl-galactosamine.

In some embodiments, disclosed herein are methods for inhibiting expression of an APOC3 gene in a cell, the methods include administering one or more APOC3 RNAi agents having the duplex structure of a duplex set forth in Table 6.

In some embodiments, disclosed herein are methods of treatment (including prophylactic or preventative treatment) of diseases, disorders, or symptoms caused by elevated TG levels and/or elevated cholesterol levels, wherein the methods include administering to a subject in need thereof a therapeutically effective amount of an APOC3 RNAi agent that includes an antisense strand that is at least partially complementary to the portion of the APOC3 mRNA having the sequence in Table 1. In some embodiments, disclosed herein are methods of treatment (including prophylactic or preventative treatment) of diseases or symptoms caused by elevated TG levels and/or elevated cholesterol levels, wherein the methods include administering to a subject in need thereof a therapeutically effective amount of an APOC3 RNAi agent that includes an antisense strand comprising the sequence of any of the sequences in Tables 2, 3, or 4, and a sense strand that comprises any of the sequences in Tables 2, 3, or 5 that is at least partially complementary to the antisense strand. In some embodiments, disclosed herein are methods of treatment (including prophylactic or preventative treatment) of diseases or symptoms caused by elevated TG levels and/or elevated cholesterol levels, wherein the methods include administering to a subject in need thereof a therapeutically effective amount of an APOC3 RNAi agent that includes a sense strand that comprises any of the sequences in Tables 2, 3, or 5, and an antisense strand comprising the sequence of any of the sequences in Tables 2, 3, or 4 that is at least partially complementary to the sense strand.

In some embodiments, disclosed herein are methods for inhibiting expression of an APOC3 gene in a cell, wherein the methods include administering to the cell an APOC3 RNAi agent that includes an antisense strand that is at least partially complementary to the portion of the APOC3 mRNA having the sequence in Table 1. In some embodiments, disclosed herein are methods of inhibiting expression of an APOC3 gene in a cell, wherein the methods include administering to a cell an APOC3 RNAi agent that includes an antisense strand comprising the sequence of any of the sequences in Tables 2, 3, or 4, and a sense strand that comprises any of the sequences in Tables 2, 3, or 5 that is at least partially complementary to the antisense strand. In some embodiments, disclosed herein are methods of inhibiting expression of an APOC3 gene in a cell, wherein the methods include administering an APOC3 RNAi agent that includes a sense strand that comprises any of the sequences in Tables 2, 3, or 5, and an antisense strand that includes the sequence of any of the sequences in Tables 2, 3, or 4 that is at least partially complementary to the sense strand.

In some embodiments, disclosed herein are compositions for inhibiting expression of an APOC3 gene in a cell, wherein the methods include administering a composition that comprises an APOC3 RNAi agent having the duplex structure of a duplex set forth in Table 6.

In some embodiments, disclosed herein are compositions for delivering an APOC3 RNAi agent to a liver cell in vivo, the composition including an APOC3 RNAi agent conjugated or linked to a targeting group. In some embodiments, the targeting group is an asialoglycoprotein receptor ligand. In some embodiments, compositions for delivering an APOC3 RNAi agent to a liver cell in vivo are described, the composition including an APOC3 RNAi agent linked to an N-acetyl-galactosamine targeting ligand.

The APOC3 RNAi agents disclosed herein are designed to target specific positions on an APOC3 gene (SEQ ID NO:1). As defined herein, an antisense strand sequence is designed to target an APOC3 gene at a given position on the gene when the 5' terminal nucleobase of the antisense strand would be aligned with the position that is 19 nucleotides downstream (towards the 3' end) from the position on the gene when base pairing to the gene. For example, as illustrated in Tables 1 and 2 herein, an antisense strand sequence designed to target an APOC3 gene at position 438 requires that when base pairing to the gene, the 5' terminal nucleobase of the antisense strand is aligned with position 456 of the APOC3 gene.

As provided herein, an APOC3 RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for an APOC3 RNAi agent disclosed herein that is designed to target position 438 of an APOC3 gene, the 5' terminal nucleobase of the antisense strand of the of the APOC3 RNAi agent must be aligned with position 456 of the gene; however, the 5' terminal nucleobase of the antisense strand may be, but is not required to be, complementary to position 456 of an APOC3 gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. As shown by, among other things, the various examples disclosed herein, the specific site of binding of the gene by the antisense strand of the APOC3 RNAi agent (e.g., whether the APOC3 RNAi agent is designed to target an APOC3 gene at position 438, at position 506, at position 432, or at some other position) is important to the level of inhibition achieved by the APOC3 RNAi agent.

The use of APOC3 RNAi agents provides methods for therapeutic (including prophylactic) treatment of diseases/disorders associated with elevated TG and/or cholesterol levels and/or enhanced or elevated APOC3 expression. The described APOC3 RNAi agents mediate RNA interference to inhibit the expression of one or more genes necessary for production of APOC3. APOC3 RNAi agents can also be used to treat or prevent various diseases or disorders, including obesity, hyperlipidemia, hypertriglyceridemia, abnormal lipid and/or cholesterol metabolism, atherosclerosis, cardiovascular disease, coronary artery disease, hypertriglyceridemia mediated pancreatitis, metabolic syndrome, type 11 diabetes mellitus, familial chylomicronemia syndrome, familial partial lipodystrophy, and other metabolic-related disorders and diseases. Furthermore, compositions for delivery of APOC3 RNAi agents to liver cells in vivo are described.

The pharmaceutical compositions including one or more APOC3 RNAi agents can be administered in a number of ways depending upon whether local or systemic treatment is desired. Administration can be, but is not limited to, intravenous, intraarterial, subcutaneous, intraperitoneal, subdermal (e.g., via an implanted device), and intraparenchymal administration. In some embodiments, the pharmaceutical compositions described herein are administered by subcutaneous injection.

In some embodiments, disclosed herein are compositions for delivering an APOC3 RNAi agent to a liver cell in vivo, wherein the composition includes an APOC3 RNAi agent conjugated or linked to a targeting group. In some embodiments, the targeting group is an asialoglycoprotein receptor ligand. In some embodiments, compositions for delivering an APOC3 RNAi agent to a liver cell in vivo are described, wherein the composition includes an APOC3 RNAi agent linked to a targeting ligand that includes N-acetyl-galactosamine.

In some embodiments, the APOC3 RNAi agents described herein can include one or more targeting groups having the structure of (NAG25), (NAG25)s, (NAG26), (NAG26)s, (NAG27), (NAG27)s, (NAG28), (NAG28)s, (NAG29), (NAG29)s, (NAG30), (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), (NAG39)s, each as defined herein in Table 7.

In some embodiments, the APOC3 RNAi agents described herein include one targeting group at the 5' end of the sense strand having the structure of (NAG25), (NAG25)s, (NAG26), (NAG26)s, (NAG27), (NAG27)s, (NAG28), (NAG28)s, (NAG29), (NAG29)s, (NAG30), (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), (NAG39)s, each as defined herein in Table 7.

The described APOC3 RNAi agents and/or compositions that include APOC3 RNAi agents can be used in methods for therapeutic treatment of diseases or conditions caused by elevated TG levels. Such methods include administration of an APOC3 RNAi agent as described herein to a subject, e.g., a human or animal subject. In some embodiments, one or more of the described APOC3 RNAi agents are administered to a subject, such as a mammal, in a pharmaceutically acceptable carrier or diluent. In some embodiments, the mammal is a human.

The APOC3 RNAi agents disclosed herein can be incorporated into a composition comprising one or more disclosed APOC3 RNAi agent and at least one pharmaceutically acceptable excipient. In some embodiments, the compositions disclosed herein comprising one or more of the disclosed APOC3 RNAi agents and at least one pharmaceutically acceptable excipient is a pharmaceutical composition.

In some embodiments, the compositions comprising one or more disclosed APOC3 RNAi agents and at least one pharmaceutically acceptable excipient can further comprise one or more additional therapeutics or treatments.

In some embodiments, the compositions described herein comprising one or more APOC3 RNAi agents are packaged in a kit, container, pack, dispenser, pre-filled syringes, or vials. In some embodiments, the compositions described herein are administered parenterally.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCUC (SEQ ID NO:3). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UCACUGAGAAUACUGUCCCUC (SEQ ID NO:3), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCUC (SEQ ID NO:3), wherein SEQ ID NO:3 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') usCfsasCfuGfagaauAfcUfgUfcCfcUfsc (SEQ ID NO:2), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. As the person of ordinary skill in the art would clearly understand, the inclusion of a phosphorothioate linkage as shown in the modified nucleotide sequences disclosed herein replaces the phosphodiester linkage typically present in oligonucleotides (see, e.g., FIGS. 1A through 1I showing all internucleoside linkages). In some embodiments, an APOC3 RNAi agent disclosed herein includes an antisense strand that consists of, consists essentially of, or comprises the nucleotide sequence (5'→3') usCfsasCfuGfagaauAfcUfgUfcCfcUfsc (SEQ ID NO:2), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCGU (SEQ ID NO:5). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UCACUGAGAAUACUGUCCCGU (SEQ ID NO:5), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCGU (SEQ ID NO:5), wherein SEQ ID NO:5 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') usCfsasCfuGfagaauAfcUfgUfcCfcGfsu (SEQ ID NO:4), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. As the person of ordinary skill in the art would clearly understand, the inclusion of a phosphorothioate linkage as shown in the modified nucleotide sequences disclosed herein replaces the phosphodiester linkage typically present in oligonucleotides (see, e.g., FIGS. 1A through 1I showing all internucleoside linkages). In some embodiments, an APOC3 RNAi agent disclosed herein includes an antisense strand that consists of, consists essentially of, or comprises the nucleotide sequence (5'→3') usCfsasCfuGfagaauAfcUfgUfcCfcGfsu (SEQ ID NO:4), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') usCfsascugagaauAfcUfgUfcCfcUfsc (SEQ ID NO:6), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. As the person of ordinary skill in the art would clearly understand, the inclusion of a phosphorothioate linkage as shown in the modified nucleotide sequences disclosed herein replaces the phosphodiester linkage typically present in oligonucleotides (see, e.g., FIGS. 1A through 1I showing all internucleoside linkages). In some embodiments, an APOC3 RNAi agent disclosed herein includes an antisense strand that consists of, consists essentially of, or comprises the nucleotide sequence (5'→3') usCfsascugagaauAfcUfgUfcCfcUfsc (SEQ ID NO:6), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UUCUUGUCCAGCUUUAUUGGC (SEQ ID NO:8). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UUCUUGUCCAGCUUUAUUGGC (SEQ ID NO:8), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UUCUUGUCCAGCUUUAUUGGC (SEQ ID NO:8), wherein SEQ ID NO:8 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') usUfscsUfuGfuCfcAfgCfuUfuAfuUfgGfsc (SEQ ID NO:7), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. In some embodiments, an APOC3 RNAi agent disclosed herein includes an antisense strand that consists of, consists essentially of, or comprises the nucleotide sequence (5'→3') usUfscsUfuGfuCfcAfgCfuUfuAfuUfgGfsc (SEQ ID NO:7), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCCUUUUAGGG (SEQ ID NO:10). In some embodiments, an APOC3 RNAi agent disclosed herein includes an antisense strand that consists of, consists essentially of, or comprises a nucleotide sequence differing by no more than 1 nucleotide from the nucleotide sequence (5'→3') AGAAUACUGUCCCUUUUAGGG (SEQ ID NO:10), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCCUUUUAGGG (SEQ ID NO:10), wherein SEQ ID NO:10 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') asGfsasAfuAfcUfgUfcCfcUfuUfuAfgGfsg (SEQ ID NO:9), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. In some embodiments, an APOC3 RNAi agent disclosed herein includes an antisense strand that consists of, consists essentially of, or comprises the nucleotide sequence (5'→3') asGfsasAfuAfcUfgUfcCfcUfuUfuAfgGfsg (SEQ ID NO:9), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCCUUUUAAGC (SEQ ID NO:12). In some embodiments, an APOC3 RNAi agent disclosed herein includes an antisense strand that consists of, consists essentially of, or comprises a nucleotide sequence differing by no more than 1 nucleotide from the nucleotide sequence (5'→3') AGAAUACUGUCCCUUUUAAGC (SEQ ID NO:12), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCCUUUUAAGC (SEQ ID NO:12), wherein SEQ ID NO:12 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') asGfsasAfuAfcUfgUfcCfcUfuUfuAfaGfsc (SEQ ID NO:11), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. In some embodiments, an APOC3 RNAi agent disclosed herein includes an antisense strand that consists of, consists essentially of, or comprises the nucleotide sequence (5'→3') asGfsasAfuAfcUfgUfcCfcUfuUfuAfaGfsc (SEQ ID NO:11), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UGAGAAUACUGUCCCUUUGCC (SEQ ID NO:14). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UGAGAAUACUGUCCCUUUGCC (SEQ ID NO:14), wherein all or substantially all of the nucleotides are modified nucleotides. In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UGAGAAUACUGUCCCUUUGCC (SEQ ID NO:14), wherein SEQ ID NO:14 is located at positions 1-21 (5'→3') of the antisense strand.

In some embodiments, an APOC3 RNAi agent disclosed herein includes an antisense strand that consists of, consists essentially of, or comprises a modified nucleotide sequence differing by no more than 1 nucleotide from the nucleotide sequence (5'→3') usGfsasGfaAfuAfcUfgUfcCfcUfuUfgcsc (SEQ ID NO:13), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand. In some embodiments, an APOC3 RNAi agent disclosed herein includes an antisense strand that consists of, consists essentially of, or comprises the nucleotide sequence (5'→3') usGfsasGfaAfuAfcUfgUfcCfcUfuUfgcsc (SEQ ID NO:13), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage, and wherein the sense strand is at least substantially complementary to the antisense strand.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCUC (SEQ ID NO:3) and a sense strand that consists of, consists essentially of, or comprises a nucleobase sequence differing by 0 or 1 nucleobases from the nucleotide sequence (5'→3') GAGGGACAGUAUUCUCAGUIA (SEQ ID NO:16). (I represents an inosine nucleotide.) In some embodiments, an APOC3 RNAi agent disclosed herein includes an antisense strand that consists of, consists essentially of, or comprises a nucleotide sequence differing by no more than 1 nucleotide from the nucleotide sequence (5'→3') UCACUGAGAAUACUGUCCCUC (SEQ ID NO:3), wherein all or substantially all of the nucleotides are modified nucleotides, and a sense strand that consists of, consists essentially of, or comprises a nucleotide sequence differing by no more than 1 nucleotide from the nucleotide sequence (5'→3') GAGGGACAGUAUUCUCAGUIA (SEQ ID NO:16), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCGU (SEQ ID NO:5) and a sense strand that consists of, consists essentially of, or comprises a nucleobase sequence differing by 0 or 1 nucleobases from the nucleotide sequence (5'→3') ACGGGACAGUAUUCUCAGUIA (SEQ ID NO:18). (I represents an inosine nucleotide.) In some embodiments, an APOC3 RNAi agent disclosed herein includes an antisense strand that consists of, consists essentially of, or comprises a nucleotide sequence differing by no more than 1 nucleotide from the nucleotide sequence (5'→3') UCACUGAGAAUACUGUCCCGU (SEQ ID NO:5), wherein all or substantially all of the nucleotides are modified nucleotides, and a sense strand that consists of, consists essentially of, or comprises a nucleotide sequence differing by no more than 1 nucleotide from the nucleotide sequence (5'→3') ACGGGACAGUAUUCUCAGUIA (SEQ ID NO:18), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UCACUGAGAAUACUGUCCCUC (SEQ ID NO:3) and a sense strand that consists of, consists essentially of, or comprises a nucleobase sequence differing by 0 or 1 nucleobases from the nucleotide sequence (5'→3') GAGGGACAGUAUUCUCAGUGA (SEQ ID NO:21). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UCACUGAGAAUACUGUCCCUC (SEQ ID NO:3), wherein all or substantially all of the nucleotides are modified nucleotides, and a sense strand that consists of, consists essentially of, or comprises a nucleotide sequence differing by no more than 1 nucleotide from the nucleotide sequence (5'→3') GAGGGACAGUAUUCUCAGUGA (SEQ ID NO:21), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UUCUUGUCCAGCUUUAUUGGC (SEQ ID NO:8) and a sense strand that consists of, consists essentially of, or comprises a nucleobase sequence differing by 0 or 1 nucleobases from the nucleotide sequence (5'→3') GCCAAUAAAGCUGGACAAGAA (SEQ ID NO:23). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UUCUUGUCCAGCUUUAUUGGC (SEQ ID NO:8), wherein all or substantially all of the nucleotides are modified nucleotides, and a sense strand that consists of, consists essentially of, or comprises a nucleotide sequence differing by no more than 1 nucleotide from the nucleotide sequence (5'→3') GCCAAUAAAGCUGGACAAGAA (SEQ ID NO:23), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UUCUUGUCCAGCUUUAUUGGC (SEQ ID NO:8) and a sense strand that consists of, consists essentially of, or comprises a nucleobase sequence differing by 0 or 1 nucleobases from the nucleotide sequence (5'→3') GCCAAUAAAICUGGACAAGAA (SEQ ID NO:25). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UUCUUGUCCAGCUUUAUUGGC (SEQ ID NO:8), wherein all or substantially all of the nucleotides are modified nucleotides, and a sense strand that consists of, consists essentially of, or comprises a nucleotide sequence differing by no more than 1 nucleotide from the nucleotide sequence (5'→3') GCCAAUAAAICUGGACAAGAA (SEQ ID NO:25), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCCUUUUAGGG (SEQ ID NO:10) and a sense strand that consists of, consists essentially of, or comprises a nucleobase sequence differing by 0 or 1 nucleobases from the nucleotide sequence (5'→3') CCCUAAAAGGGACAGUAUUCU (SEQ ID NO:27). In some embodiments, an APOC3 RNAi agent disclosed herein includes an antisense strand that consists of, consists essentially of, or comprises a nucleotide sequence differing by no more than 1 nucleotide from the nucleotide sequence (5'→3') AGAAUACUGUCCCUUUUAGGG (SEQ ID NO:10), wherein all or substantially all of the nucleotides are modified nucleotides, and a sense strand that consists of, consists essentially of, or comprises a nucleotide sequence differing by no more than 1 nucleotide from the nucleotide sequence (5'→3') CCCUAAAAGGGACAGUAUUCU (SEQ ID NO:27), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') AGAAUACUGUCCUUUUAAGC (SEQ ID NO:12) and a sense strand that consists of, consists essentially of, or comprises a nucleobase sequence differing by 0 or 1 nucleobases from the nucleotide sequence (5'→3') GCUUAAAAGGGACAGUAUUCU (SEQ ID NO:29). In some embodiments, an APOC3 RNAi agent disclosed herein includes an antisense strand that consists of, consists essentially of, or comprises a nucleotide sequence differing by no more than 1 nucleotide from the nucleotide sequence (5'→3') AGAAUACUGUCCCUUUUAAGC (SEQ ID NO:12), wherein all or substantially all of the nucleotides are modified nucleotides, and a sense strand that consists of, consists essentially of, or comprises a nucleotide sequence differing by no more than 1 nucleotide from the nucleotide sequence (5'→3') GCUUAAAAGGGACAGUAUUCU (SEQ ID NO:29), wherein all or substantially all of the nucleotides are modified nucleotides.

In some embodiments, an APOC3 RNAi agent disclosed herein includes an antisense strand that consists of, consists essentially of, or comprises a nucleobase sequence differing by 0 or 1 nucleobases from the nucleotide sequence (5'→3') UGAGAAUACUGUCCCUUUGCC (SEQ ID NO:14) and a sense strand that consists of, consists essentially of, or comprises a nucleobase sequence differing by 0 or 1 nucleobases from the nucleotide sequence (5'→3') GGCAAAGGGACAGUAUUCUCA (SEQ ID NO:31). In some embodiments, an APOC3 RNAi agent disclosed herein includes an antisense strand that consists of, consists essentially of, or comprises a nucleotide sequence differing by no more than 1 nucleotide from the nucleotide sequence (5'→3') UGAGAAUACUGUCCCUUUGCC (SEQ ID NO:14), wherein all or substantially all of the nucleotides are modified nucleotides, and a sense strand that consists of, consists essentially of, or comprises a nucleotide sequence differing by no more than 1 nucleotide from the nucleotide sequence (5'→3') GGCAAAGGGACAGUAUUCUCA (SEQ ID NO:31), wherein all or substantially all of the nucleotides are modified nucleotides.

In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcUfsc (SEQ ID NO:2), and a sense strand that consists of, consists essentially of, or comprises the modified nucleotide sequence (5'→3') gagggacaGfUfAfuucucaguia (SEQ ID NO:15), wherein a, c, g, i, and u represent 2'-O-methyl adenosine, cytidine, guanosine, inosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcUfsc (SEQ ID NO:2), and a sense strand that consists of, consists essentially of, or comprises the modified nucleotide sequence (5'→3') gagggacaGfUfAfuucucaguia (SEQ ID NO:15), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcUfsu (SEQ ID NO:4), and a sense strand that consists of, consists essentially of, or comprises the modified nucleotide sequence (5'→3') acgggacaGfUfAfuucucaguia (SEQ ID NO:17), wherein a, c, g, i, and u represent 2'-O-methyl adenosine, cytidine, guanosine, inosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcGfsu (SEQ ID NO:4), and a sense strand that consists of, consists essentially of, or comprises the modified nucleotide sequence (5'→3') acgggacaGfUfAfuucucaguia (SEQ ID NO:17), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usCfsascugagaauAfcUfgUfcCfcUfsc (SEQ ID NO:6), and a sense strand that consists of, consists essentially of, or comprises the modified nucleotide sequence (5'→3') gagggacaGfuAfuUfcucaguia (SEQ ID NO:19), wherein a, c, g, i, and u represent 2'-O-methyl adenosine, cytidine, guanosine, inosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usCfsascugagaauAfcUfgUfcCfcUfsc (SEQ ID NO:6), and a sense strand that consists of, consists essentially of, or comprises the modified nucleotide sequence (5'→3') gagggacaGfuAfuUfcucaguia (SEQ ID NO:19), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcUfsc (SEQ ID NO:2), and a sense strand that consists of, consists essentially of, or comprises the modified nucleotide sequence (5'→3') gagggacaGfUfAfuucucaguga (SEQ ID NO:20), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usCfsasCfuGfagaauAfcUfgUfcCfcUfsc (SEQ ID NO:2), and a sense strand that consists of, consists essentially of, or comprises the modified nucleotide sequence (5'→3') gagggacaGfUfAfuucucaguga (SEQ ID NO:20), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usUfscsUfuGfuCfcAfgCfuUfuAfuUfgGfsc (SEQ ID NO:7), and a sense strand that consists of, consists essentially of, or comprises the modified nucleotide sequence (5'→3') gccaauaaAfGfCfuggacaagaa (SEQ ID NO:22), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usUfscsUfuGfuCfcAfgCfuUfuAfuUfgGfsc (SEQ ID NO:7), and a sense strand that consists of, consists essentially of, or comprises the modified nucleotide sequence (5'→3') gccaauaaAfGfCfuggacaagaa (SEQ ID NO:22), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usUfscsUfuGfuCfcAfgCfuUfuAfuUfgGfsc (SEQ ID NO:7), and a sense strand that consists of, consists essentially of, or comprises the modified nucleotide sequence (5'→3') gccaauaaAflfCfuggacaagaa (SEQ ID NO:24), wherein a, c, g, and u represent 2'-O-methyl adenosine, cytidine, guanosine, or uridine, respectively; Af, Cf, Gf, If, and Uf represent 2'-fluoro adenosine, cytidine, guanosine, inosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usUfscsUfuGfuCfcAfgCfuUfuAfuUfgGfsc (SEQ ID NO:7), and a sense strand that consists of, consists essentially of, or comprises the modified nucleotide sequence (5'→3') gccaauaaAflfCfuggacaagaa (SEQ ID NO:24), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') asGfsasAfuAfcUfgUfcCfcUfuUfuAfgGfsg (SEQ ID NO:9), and a sense strand that consists of, consists essentially of, or comprises the modified nucleotide sequence (5'→3') cccuaaaaGfGfGfacaguauucu (SEQ ID NO:26), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') asGfsasAfuAfcUfgUfcCfcUfuUfuAfgGfsg (SEQ ID NO:9), and a sense strand that consists of, consists essentially of, or comprises the modified nucleotide sequence (5'→3') cccuaaaaGfGfGfacaguauucu (SEQ ID NO:26), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') asGfsasAfuAfcUfgUfcCfcUfuUfuAfaGfsc (SEQ ID NO:11), and a sense strand that consists of, consists essentially of, or comprises the modified nucleotide sequence (5'→3') gcuuaaaaGfGfGfacaguauucu (SEQ ID NO:28), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') asGfsasAfuAfcUfgUfcCfcUfuUfuAfaGfsc (SEQ ID NO:11), and a sense strand that consists of, consists essentially of, or comprises the modified nucleotide sequence (5'→3') gcuuaaaaGfGfGfacaguauucu (SEQ ID NO:28), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises the modified nucleotide sequence (5'→3') usGfsasGfaAfuAfcUfgUfcCfcUfuUfgcsc (SEQ ID NO:13), and a sense strand that consists of, consists essentially of, or comprises the modified nucleotide sequence (5'→3') ggcaaaggGfAfCfaguauucuca (SEQ ID NO:30), wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; and s represents a phosphorothioate linkage. In some embodiments, an APOC3 RNAi agent disclosed herein includes an antisense strand that consists of, consists essentially of, or comprises the modified nucleotide sequence (5'→3') usGfsasGfaAfuAfcUfgUfcCfcUfuUfgcsc (SEQ ID NO:13), and a sense strand that consists of, consists essentially of, or comprises the modified nucleotide sequence (5'→3') ggcaaaggGfAfCfaguauucuca (SEQ ID NO:30), and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises a nucleotide sequence that differs by 0 or 1 nucleotides from one of the following nucleotide sequences (5'→3'):

```
                                  (SEQ ID NO: 3)
UCACUGAGAAUACUGUCCCUC;

(SEQ ID NO: 5)
UCACUGAGAAUACUGUCCCGU;

(SEQ ID NO: 8)
UUCUUGUCCAGCUUUAUUGGC;

(SEQ ID NO: 10)
AGAAUACUGUCCCUUUUAGGG;

(SEQ ID NO: 12)
AGAAUACUGUCCCUUUUAAGC;
or (SEQ ID NO: 14)
UGAGAAUACUGUCCCUUUGCC;
``` wherein the APOC3 RNAi agent further includes a sense strand that is at least partially complementary to the antisense strand; and wherein all or substantially all of the nucleotides on both the antisense strand and the sense strand are modified nucleotides.

In some embodiments, an APOC3 RNAi agent disclosed herein includes an antisense strand that consists of, consists essentially of, or comprises a nucleotide sequence that differs by 0 or 1 nucleotides from one of the following nucleotide sequences (5'→3'):

```
                                  (SEQ ID NO: 3)
UCACUGAGAAUACUGUCCCUC;

(SEQ ID NO: 5)
UCACUGAGAAUACUGUCCCGU;

(SEQ ID NO: 8)
UUCUUGUCCAGCUUUAUUGGC;

(SEQ ID NO: 10)
AGAAUACUGUCCCUUUUAGGG;

(SEQ ID NO: 12)
AGAAUACUGUCCCUUUUAAGC;
or (SEQ ID NO: 14)
UGAGAAUACUGUCCCUUUGCC;
``` wherein the APOC3 RNAi agent further includes a sense strand that is at least partially complementary to the antisense strand; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises a nucleotide sequence that differs by 0 or 1 nucleotides from one of the following nucleotide sequences (5'→3'):

UCACUGAGAAUACUGUCCCUC; (SEQ ID NO: 3)

UCACUGAGAAUACUGUCCCGU; (SEQ ID NO: 5)

UUCUUGUCCAGCUUUAUUGGC; (SEQ ID NO: 8)

AGAAUACUGUCCCUUUUAGGG; (SEQ ID NO: 10)

AGAAUACUGUCCCUUUUAAGC; (SEQ ID NO: 12)
or

UGAGAAUACUGUCCCUUUGCC; (SEQ ID NO: 14)

wherein the APOC3 RNAi agent further includes a sense strand that is at least partially complementary to the antisense strand; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine; and wherein the respective antisense strand sequence is located at positions 1-21 of the antisense strand.

In some embodiments, an APOC3 RNAi agent disclosed herein includes an antisense strand and a sense strand, wherein the antisense strand and the sense strand consist of, consist essentially of, or comprise nucleotide sequences that differ by 0 or 1 nucleotides from one of the following nucleotide sequence (5'→3') pairs:

UCACUGAGAAUACUGUCCCUC (SEQ ID NO: 3)
and

GAGGGACAGUAUUCUCAGUIA; (SEQ ID NO: 16)

UCACUGAGAAUACUGUCCCGU (SEQ ID NO: 5)
and

ACGGGACAGUAUUCUCAGUIA; (SEQ ID NO: 18)

UCACUGAGAAUACUGUCCCUC (SEQ ID NO: 3)
and

GAGGGACAGUAUUCUCAGUGA; (SEQ ID NO: 21)

UUCUUGUCCAGCUUUAUUGGC (SEQ ID NO: 8)
and

GCCAAUAAAGCUGGACAAGAA; (SEQ ID NO: 23)

UUCUUGUCCAGCUUUAUUGGC (SEQ ID NO: 8)
and

GCCAAUAAAICUGGACAAGAA; (SEQ ID NO: 25)

AGAAUACUGUCCCUUUUAGGG (SEQ ID NO: 10)
and

CCCUAAAAGGGACAGUAUUCU; (SEQ ID NO: 27)

AGAAUACUGUCCCUUUUAAGC (SEQ ID NO: 12)
and

GCUUAAAAGGGACAGUAUUCU; (SEQ ID NO: 29)
or

UGAGAAUACUGUCCCUUUGCC (SEQ ID NO: 14)
and

GGCAAAGGGACAGUAUUCUCA; (SEQ ID NO: 31)

wherein all or substantially all of the nucleotides on both the antisense strand and the sense strand are modified nucleotides.

In some embodiments, an APOC3 RNAi agent disclosed herein includes an antisense strand and a sense strand, wherein the antisense strand and the sense strand consist of, consist essentially of, or comprise nucleotide sequences that differ by 0 or 1 nucleotides from one of the following nucleotide sequences (5'→3') pairs:

UCACUGAGAAUACUGUCCCUC (SEQ ID NO: 3)
and

GAGGGACAGUAUUCUCAGUIA; (SEQ ID NO: 16)

UCACUGAGAAUACUGUCCCGU (SEQ ID NO: 5)
and

ACGGGACAGUAUUCUCAGUIA; (SEQ ID NO: 18)

UCACUGAGAAUACUGUCCCUC (SEQ ID NO: 3)
and

GAGGGACAGUAUUCUCAGUGA; (SEQ ID NO: 21)

UUCUUGUCCAGCUUUAUUGGC (SEQ ID NO: 8)
and

GCCAAUAAAGCUGGACAAGAA; (SEQ ID NO: 23)

UUCUUGUCCAGCUUUAUUGGC (SEQ ID NO: 8)
and

GCCAAUAAAICUGGACAAGAA; (SEQ ID NO: 25)

AGAAUACUGUCCCUUUUAGGG (SEQ ID NO: 10)
and (SEQ ID NO: 27)
CCCUAAAAGGGACAGUAUUCU;

(SEQ ID NO: 12)
AGAAUACUGUCCCUUUUAAGC
and (SEQ ID NO: 29)
GCUUAAAAGGGACAGUAUUCU;
or (SEQ ID NO: 14)
UGAGAAUACUGUCCCUUUGCC
and (SEQ ID NO: 31)
GGCAAAGGGACAGUAUUCUCA;

wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand that consists of, consists essentially of, or comprises a modified nucleotide sequence that differs by 0 or 1 nucleotides from one of the following nucleotide sequences (5'→3'):

(SEQ ID NO: 2)
usCfsasCfuGfagaauAfcUfgUfcCfcUfsc;

(SEQ ID NO: 4)
usCfsasCfuGfagaauAfcUfgUfcCfcGfsu;

(SEQ ID NO: 6)
usCfsascugagaauAfcUfgUfcCfcUfsc;

(SEQ ID NO: 7)
usUfscsUfuGfuCfcAfgCfuUfuAfuUfgGfsc;

(SEQ ID NO: 9)
asGfsasAfuAfcUfgUfcCfcUfuUfuAfgGfsg;

(SEQ ID NO: 11)
asGfsasAfuAfcUfgUfcCfcUfuUfuAfaGfsc;
or (SEQ ID NO: 13)
usGfsasGfaAfuAfcUfgUfcCfcUfuUfgcsc;

wherein a, c, g, and u represent 2'-O-methyl adenosine, cytidine, guanosine, or uridine, respectively; Af, Cf, Gf, and Uf represent 2'-fluoro adenosine, cytidine, guanosine, or uridine, respectively; s represents a phosphorothioate linkage; and wherein the APOC3 RNAi agent further includes the sense strand that is at least partially complementary to the antisense strand; and wherein all or substantially all of the nucleotides on the sense strand are modified nucleotides.

In some embodiments, an APOC3 RNAi agent disclosed herein includes an antisense strand that consists of, consists essentially of, or comprises a modified nucleotide sequence that differs by 0 or 1 nucleotides from one of the following nucleotide sequences (5'→3'):

(SEQ ID NO: 2)
usCfsasCfuGfagaauAfcUfgUfcCfcUfsc;

(SEQ ID NO: 4)
usCfsasCfuGfagaauAfcUfgUfcCfcGfsu;

(SEQ ID NO: 6)
usCfsascugagaauAfcUfgUfcCfcUfsc;

(SEQ ID NO: 7)
usUfscsUfuGfuCfcAfgCfuUfuAfuUfgGfsc;

(SEQ ID NO: 9)
asGfsasAfuAfcUfgUfcCfcUfuUfuAfgGfsg;

(SEQ ID NO: 11)
asGfsasAfuAfcUfgUfcCfcUfuUfuAfaGfsc;
or (SEQ ID NO: 13)
usGfsasGfaAfuAfcUfgUfcCfcUfuUfgcsc;

wherein the APOC3 RNAi agent further includes the sense strand that is at least partially complementary to the antisense strand; wherein all or substantially all of the nucleotides on the sense strand are modified nucleotides; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes N-acetyl-galactosamine.

In some embodiments, an APOC3 RNAi agent disclosed herein includes an antisense strand and a sense strand that consists of, consists essentially of, or comprises modified nucleotide sequences that differs by 0 or 1 nucleotides from one of the following nucleotide sequence pairs (5'→3'):

(SEQ ID NO: 2)
usCfsasCfuGfagaauAfcUfgUfcCfcUfsc
and (SEQ ID NO: 15)
gagggacaGfUfAfuucucaguia;

(SEQ ID NO: 4)
usCfsasCfuGfagaauAfcUfgUfcCfcGfsu
and (SEQ ID NO: 17)
acgggacaGfUfAfuucucaguia;

(SEQ ID NO: 6)
usCfsascugagaauAfcUfgUfcCfcUfsc
and (SEQ ID NO: 19)
gagggacaGfuAfuUfcucaguia;

(SEQ ID NO: 2)
usCfsasCfuGfagaauAfcUfgUfcCfcUfsc
and (SEQ ID NO: 20)
gagggacaGfUfAfuucucaguga;

(SEQ ID NO: 7)
usUfscsUfuGfuCfcAfgCfuUfuAfuUfgGfsc
and (SEQ ID NO: 22)
gccaauaaAfGfCfuggacaagaa;

-continued

```
                                        (SEQ ID NO: 7)
usUfscsUfuGfuCfcAfgCfuUfuAfuUfgGfsc
and (SEQ ID NO: 24)
gccaauaaAfIfCfuggacaagaa;

(SEQ ID NO: 9)
asGfsasAfuAfcUfgUfcCfcUfuUfuAfgGfsg
and (SEQ ID NO: 26)
cccuaaaaGfGfGfacaguauucu;

(SEQ ID NO: 11)
asGfsasAfuAfcUfgUfcCfcUfuUfuAfaGfsc
and (SEQ ID NO: 28)
gcuuaaaaGfGfGfacaguauucu;
or (SEQ ID NO: 13)
usGfsasGfaAfuAfcUfgUfcCfcUfuUfgcsc
and (SEQ ID NO: 30)
ggcaaaggGfAfCfaguauucuca;
``` wherein a, c, g, i, and u represent 2′-O-methyl adenosine, cytidine, guanosine, inosine, or uridine, respectively; Af, Cf, Gf, If, and Uf represent 2′-fluoro adenosine, cytidine, guanosine, inosine or uridine, respectively; and s represents a phosphorothioate linkage.

In some embodiments, an APOC3 RNAi agent disclosed herein includes an antisense strand and a sense strand that consists of, consists essentially of, or comprises one of the following nucleotide sequence pairs (5′→3′):

```
                                        (SEQ ID NO: 2)
usCfsasCfuGfagaauAfcUfgUfcCfcUfsc
and (SEQ ID NO: 15)
gagggacaGfUfAfuucucaguia;

(SEQ ID NO: 4)
usCfsasCfuGfagaauAfcUfgUfcCfcGfsu
and (SEQ ID NO: 17)
acgggacaGfUfAfuucucaguia;

(SEQ ID NO: 6)
usCfsascugagaauAfcUfgUfcCfcUfsc
and (SEQ ID NO: 19)
gagggacaGfuAfuUfcucaguia;

(SEQ ID NO: 2)
usCfsasCfuGfagaauAfcUfgUfcCfcUfsc
and (SEQ ID NO: 20)
gagggacaGfUfAfuucucaguga;

(SEQ ID NO: 7)
usUfscsUfuGfuCfcAfgCfuUfuAfuUfgGfsc
and (SEQ ID NO: 22)
gccaauaaAfGfCfuggacaagaa;

(SEQ ID NO: 7)
usUfscsUfuGfuCfcAfgCfuUfuAfuUfgGfsc
and
```

```
                                       (SEQ ID NO: 24)
gccaauaaAfIfCfuggacaagaa;

(SEQ ID NO: 9)
asGfsasAfuAfcUfgUfcCfcUfuUfuAfgGfsg
and (SEQ ID NO: 26)
cccuaaaaGfGfGfacaguauucu;

(SEQ ID NO: 11)
asGfsasAfuAfcUfgUfcCfcUfuUfuAfaGfsc
and (SEQ ID NO: 28)
gcuuaaaaGfGfGfacaguauucu;
or (SEQ ID NO: 13)
usGfsasGfaAfuAfcUfgUfcCfcUfuUfgcsc
and (SEQ ID NO: 30)
ggcaaaggGfAfCfaguauucuca;
``` wherein a, c, g, i, and u represent 2′-O-methyl adenosine, cytidine, guanosine, inosine, or uridine, respectively; Af, Cf, Gf, If, and Uf represent 2′-fluoro adenosine, cytidine, guanosine, inosine or uridine, respectively; s represents a phosphorothioate linkage; and wherein the sense strand further includes inverted abasic residues at the 3′ terminal end and at the 5′ end of the nucleotide sequence, and the sense strand also includes a targeting ligand that is covalently linked to the 5′ terminal end, wherein the targeting ligand includes N-acetyl-galactosamine.

In some embodiments, an APOC3 RNAi agent disclosed herein includes an antisense strand that includes a nucleobase sequence that differs by 0 or 1 nucleobases from the nucleotide sequences selected from the group consisting of (5′→3′):

```
                                       (SEQ ID NO: 49)
UCACUGAGAAUACUGUCCC;

(SEQ ID NO: 53)
UUCUUGUCCAGCUUUAUUG;

(SEQ ID NO: 57)
AGAAUACUGUCCCUUUUAA;

(SEQ ID NO: 58)
AGAAUACUGUCCCUUUUAG;
or (SEQ ID NO: 106)
UGAGAAUACUGUCCCUUUG.
```

In some embodiments, an APOC3 RNAi agent disclosed herein includes an antisense strand that includes a nucleobase sequence that differs by 0 or 1 nucleobases from the nucleotide sequences selected from the group consisting of (5′→3′):

```
                                       (SEQ ID NO: 49)
UCACUGAGAAUACUGUCCC;

(SEQ ID NO: 53)
UUCUUGUCCAGCUUUAUUG;

(SEQ ID NO: 57)
AGAAUACUGUCCCUUUUAA;
```

```
                                            (SEQ ID NO: 58)
AGAAUACUGUCCCUUUUAG;
or
                                            (SEQ ID NO: 106)
UGAGAAUACUGUCCCUUUG;
```
and
wherein all or substantially all of the nucleotides are modified nucleotides.

In some embodiments, an APOC3 RNAi agent disclosed herein includes an antisense strand that includes a nucleobase sequence that differs by 0 or 1 nucleobases from the nucleotide sequences selected from the group consisting of (5'→3'):

```
                                            (SEQ ID NO: 49)
UCACUGAGAAUACUGUCCC;
                                            (SEQ ID NO: 53)
UUCUUGUCCAGCUUUAUUG;
                                            (SEQ ID NO: 57)
AGAAUACUGUCCCUUUUAA;
                                            (SEQ ID NO: 58)
AGAAUACUGUCCCUUUUAG;
or
                                            (SEQ ID NO: 106)
UGAGAAUACUGUCCCUUUG;
```
and
wherein all or substantially all of the nucleotides are modified nucleotides, and wherein SEQ ID NO:49, SEQ ID NO:53, SEQ ID NO:57, SEQ ID NO:58, or SEQ ID NO:106, respectively, is located at nucleotide positions 1-19 (5'→3') of the antisense strand.

In some embodiments, an APOC3 RNAi agent disclosed herein includes an antisense strand and a sense strand that each include a nucleobase sequences that differs by 0 or 1 nucleobases from the nucleotide sequence pairs selected from the group consisting of (5'→3'):

```
                                            (SEQ ID NO: 49)
UCACUGAGAAUACUGUCCC
and
                                            (SEQ ID NO: 113)
GGGACAGUAUUCUCAGUIA;
                                            (SEQ ID NO: 49)
UCACUGAGAAUACUGUCCC
and
                                            (SEQ ID NO: 112)
GGGACAGUAUUCUCAGUGA;
                                            (SEQ ID NO: 53)
UUCUUGUCCAGCUUUAUUG
and
                                            (SEQ ID NO: 117)
CAAUAAAGCUGGACAAGAA;
                                            (SEQ ID NO: 53)
UUCUUGUCCAGCUUUAUUG
and
                                            (SEQ ID NO: 118)
CAAUAAAICUGGACAAGAA;
                                            (SEQ ID NO: 57)
AGAAUACUGUCCCUUUUAA
and
                                            (SEQ ID NO: 122)
UUAAAAGGGACAGUAUUCU;
                                            (SEQ ID NO: 58)
AGAAUACUGUCCCUUUUAG
and
                                            (SEQ ID NO: 123)
CUAAAAGGGACAGUAUUCU;
or
                                            (SEQ ID NO: 106)
UGAGAAUACUGUCCCUUUG
and
                                            (SEQ ID NO: 171)
CAAAGGGACAGUAUUCUCA.
```

In some embodiments, an APOC3 RNAi agent disclosed herein includes an antisense strand and a sense strand that each include a nucleobase sequences that differs by 0 or 1 nucleobases from the nucleotide sequence pairs selected from the group consisting of (5'→3'):

```
                                            (SEQ ID NO: 49)
UCACUGAGAAUACUGUCCC
and
                                            (SEQ ID NO: 113)
GGGACAGUAUUCUCAGUIA;
                                            (SEQ ID NO: 49)
UCACUGAGAAUACUGUCCC
and
                                            (SEQ ID NO: 112)
GGGACAGUAUUCUCAGUGA;
                                            (SEQ ID NO: 53)
UUCUUGUCCAGCUUUAUUG
and
                                            (SEQ ID NO: 117)
CAAUAAAGCUGGACAAGAA;
                                            (SEQ ID NO: 53)
UUCUUGUCCAGCUUUAUUG
and
                                            (SEQ ID NO: 118)
CAAUAAAICUGGACAAGAA;
                                            (SEQ ID NO: 57)
AGAAUACUGUCCCUUUUAA
and
                                            (SEQ ID NO: 122)
UUAAAAGGGACAGUAUUCU;
                                            (SEQ ID NO: 58)
AGAAUACUGUCCCUUUUAG
and
                                            (SEQ ID NO: 123)
CUAAAAGGGACAGUAUUCU;
or
                                            (SEQ ID NO: 106)
UGAGAAUACUGUCCCUUUG
and
                                            (SEQ ID NO: 171)
CAAAGGGACAGUAUUCUCA.
``` and wherein all or substantially all of the nucleotides are modified nucleotides.

As used herein, the terms "oligonucleotide" and "polynucleotide" mean a polymer of linked nucleosides each of which can be independently modified or unmodified.

As used herein, an "RNAi agent" (also referred to as an "RNAi trigger") means a composition that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: short (or small) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e., APOC3 mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or similar conditions in vitro)) and form a duplex or double helical structure under certain standard conditions with an oligonucleotide or polynucleotide including the second nucleotide sequence. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an APOC3 mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The inventions disclosed herein encompass nucleotide sequences substantially identical to those disclosed herein.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the preventative treatment, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol as used herein means that any group or groups may be linked thereto that is in accordance with the scope of the inventions described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other objects, features, aspects, and advantages of the invention will be apparent from the following detailed description, accompanying figures, and from the claims.

BRIEF DESCRIPTION OF THE DRAWINGS

FIG. 1A. Schematic diagram of the modified sense and antisense strands of APOC3 RNAi agent AD05251 (see Tables 4-6), conjugated to a tridentate N-acetyl-galactosamine-containing targeting ligand having the structure of (NAG37)s (see Table 7). FIG. 1A discloses SEQ ID NOs: 2 and 501.

The following abbreviations are used in FIGS. 1A to 1I: a, c, g, i, and u are 2'-O-methyl modified nucleotides (for i, the nucleobase is hypoxanthine (i.e., the base for inosine nucleotides)); Af, Cf, Gf, If, and Uf are 2'-fluoro modified nucleotides (for I, the nucleobase is hypoxanthine (i.e., the base for inosine nucleotides); p is a phosphodiester linkage; s is a phosphorothioate linkage; invAb is an inverted abasic (deoxyribose) residue (see Table 7); and (NAG37)s is a tridentate N-acetyl-galactosamine targeting ligand having the structure depicted in Table 7.

Figures 1A, 1B, 1C:
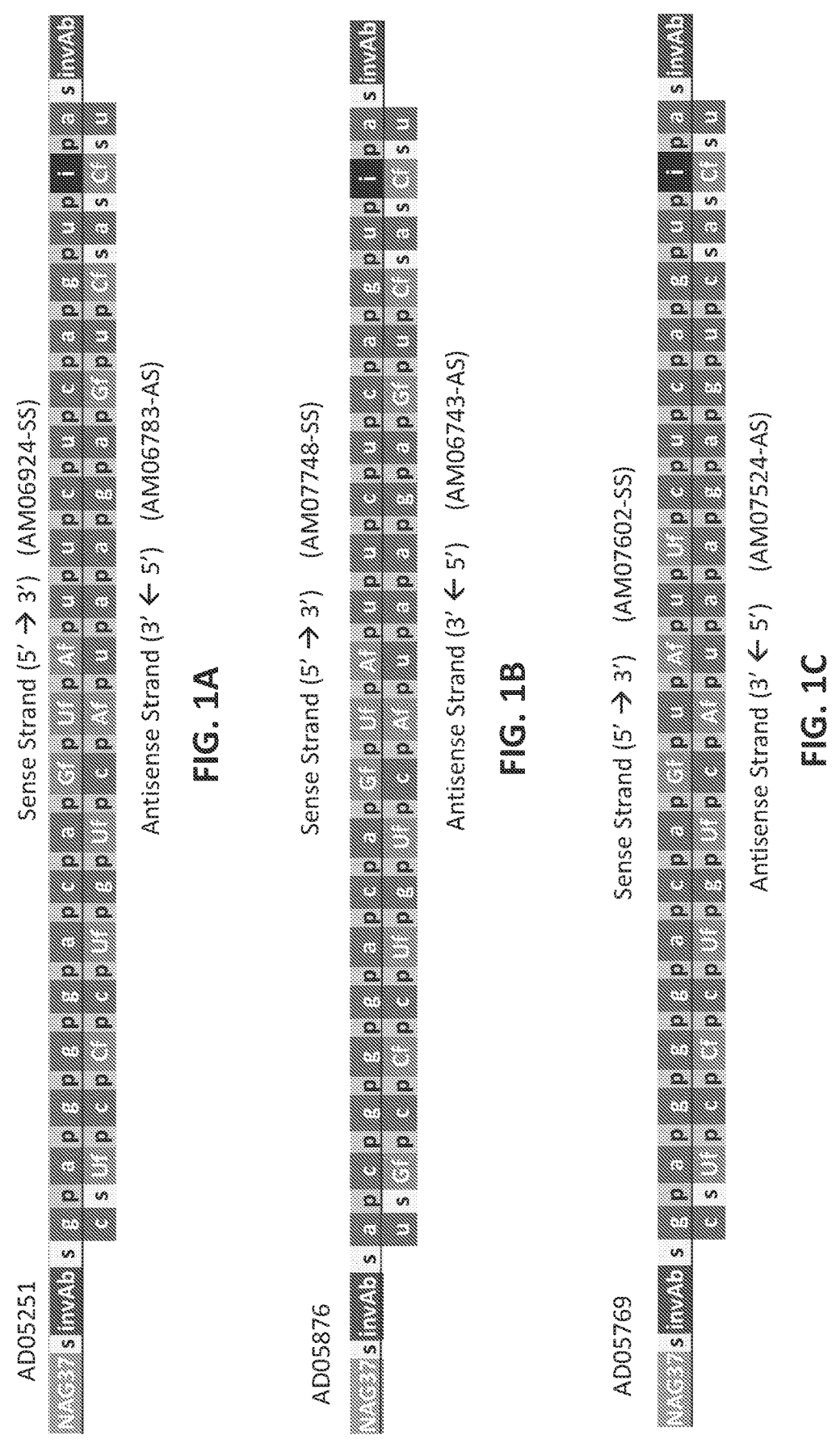

FIG. 1B. Schematic diagram of the modified sense and antisense strands of APOC3 RNAi agent AD05876 (see Tables 4-6), conjugated to a tridentate N-acetyl-galactosamine-containing targeting ligand having the structure of (NAG37)s (see Table 7). FIG. 1B discloses SEQ ID NOs: 4 and 572.

FIG. 1C. Schematic diagram of the modified sense and antisense strands of APOC3 RNAi agent AD05769 (see Tables 4-6), conjugated to a tridentate N-acetyl-galactosamine-containing targeting ligand having the structure of (NAG37)s (see Table 7). FIG. 1C discloses SEQ ID NOs: 6 and 557.

FIG. 1D. Schematic diagram of the modified sense and antisense strands of APOC3 RNAi agent AD05169 (see Tables 4-6), conjugated to a tridentate N-acetyl-galactosamine-containing targeting ligand having the structure of (NAG37)s (see Table 7). FIG. 1D discloses SEQ ID NOs: 2 and 482.

FIG. 1E. Schematic diagram of the modified sense and antisense strands of APOC3 RNAi agent AD05220 (see Tables 4-6), conjugated to a tridentate N-acetyl-galactosamine-containing targeting ligand having the structure of (NAG37)s (see Table 7). FIG. 1E discloses SEQ ID NOs: 7 and 494.

FIG. 1F. Schematic diagram of the modified sense and antisense strands of APOC3 RNAi agent AD05547 (see Tables 4-6), conjugated to a tridentate N-acetyl-galactosamine-containing targeting ligand having the structure of (NAG37)s (see Table 7). FIG. 1F discloses SEQ ID NOs: 7 and 545.

Figures 1G, 1H, 1I:
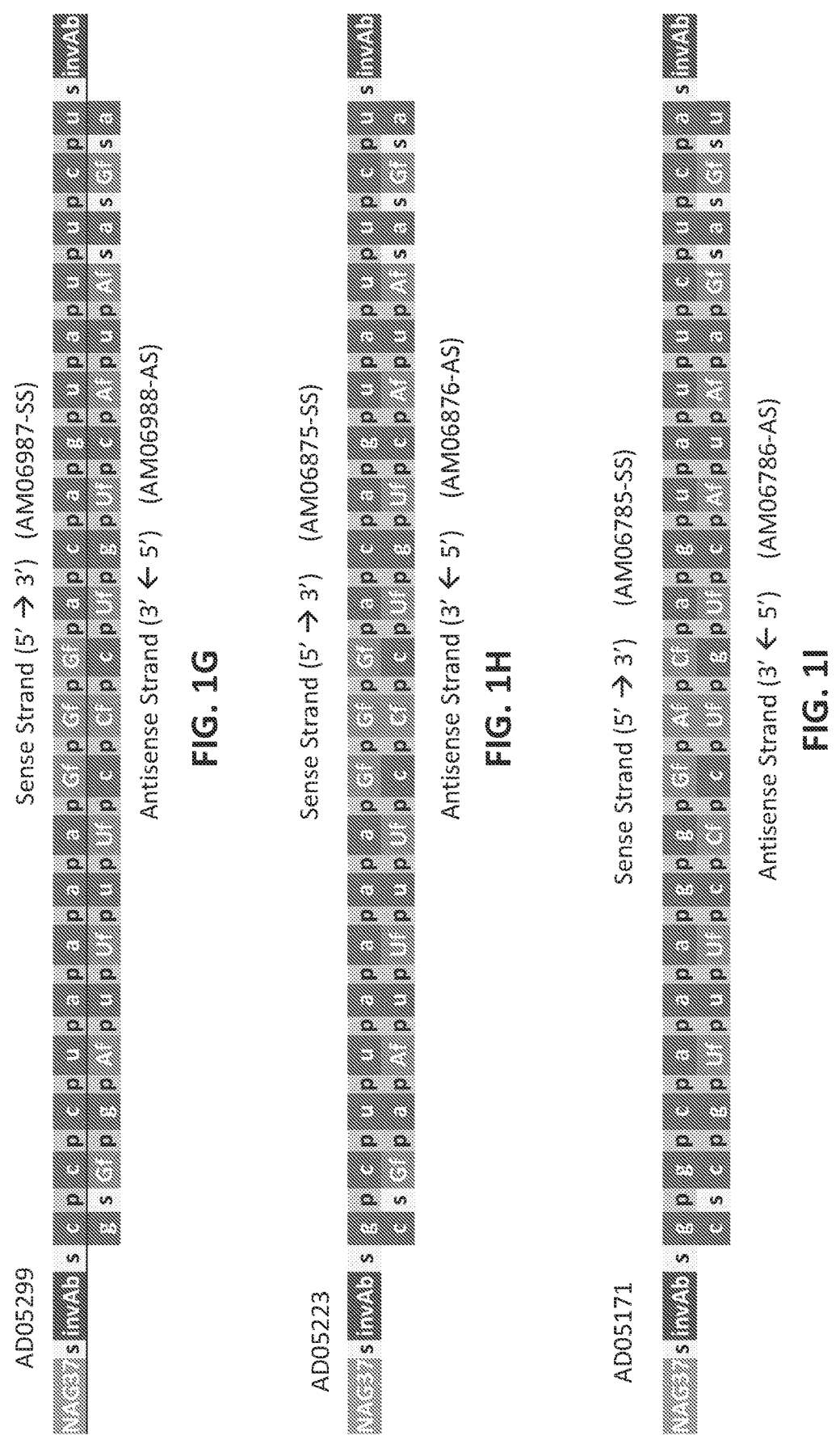

FIG. 1G. Schematic diagram of the modified sense and antisense strands of APOC3 RNAi agent AD05299 (see Tables 4-6), conjugated to a tridentate N-acetyl-galactosamine-containing targeting ligand having the structure of (NAG37)s (see Table 7). FIG. 1G discloses SEQ ID NOs: 9 and 521.

FIG. 1H. Schematic diagram of the modified sense and antisense strands of APOC3 RNAi agent AD05223 (see Tables 4-6), conjugated to a tridentate N-acetyl-galactosamine-containing targeting ligand having the structure of (NAG37)s (see Table 7). FIG. 1H discloses SEQ ID NOs: 11 and 497.

FIG. H. Schematic diagram of the modified sense and antisense strands of APOC3 RNAi agent AD05171 (see Tables 4-6), conjugated to a tridentate N-acetyl-galactosamine-containing targeting ligand having the structure of (NAG37)s (see Table 7). FIG. 1A discloses SEQ ID NOs: 13 and 483.

Figure 2A:
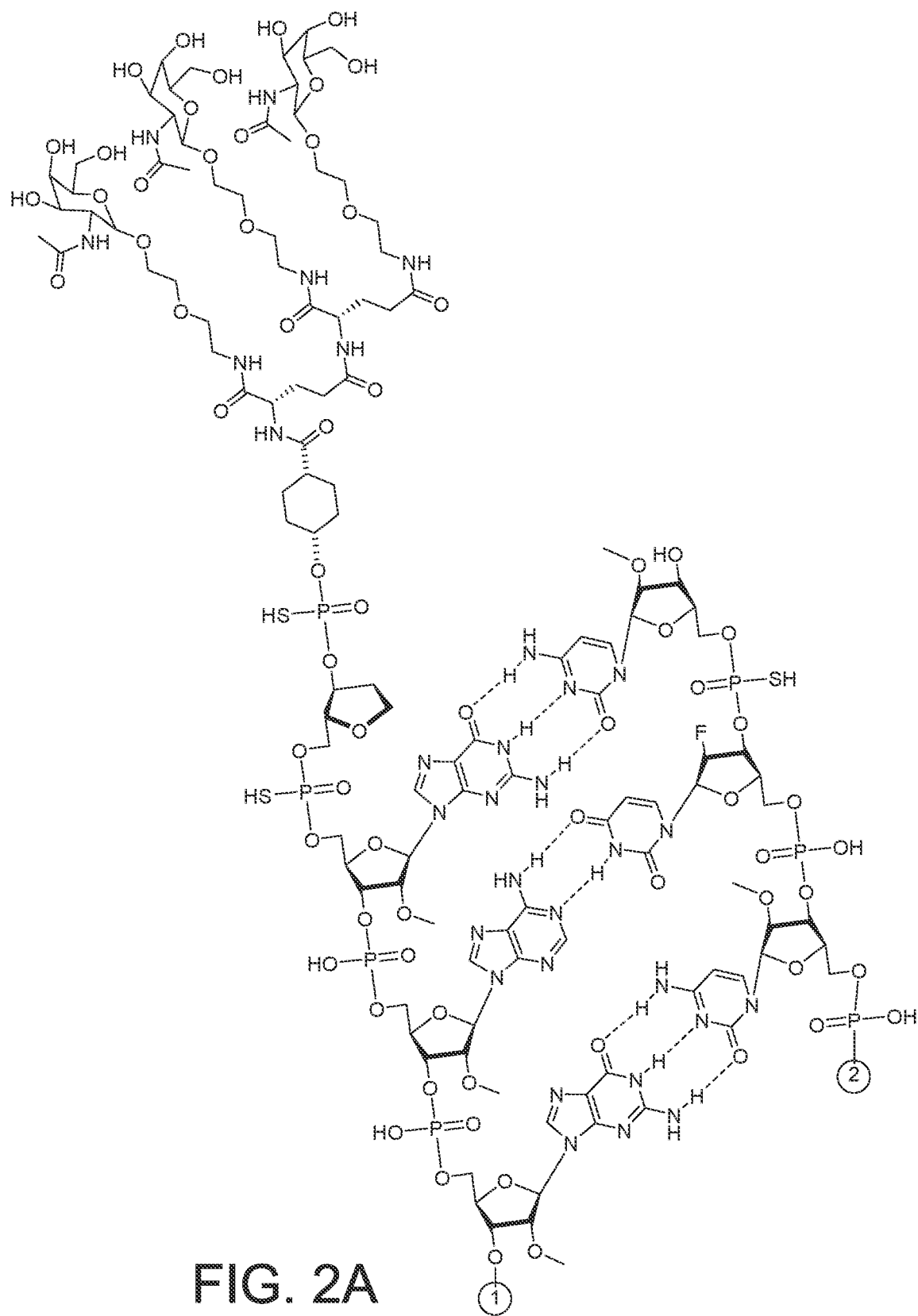
Figure 2B:
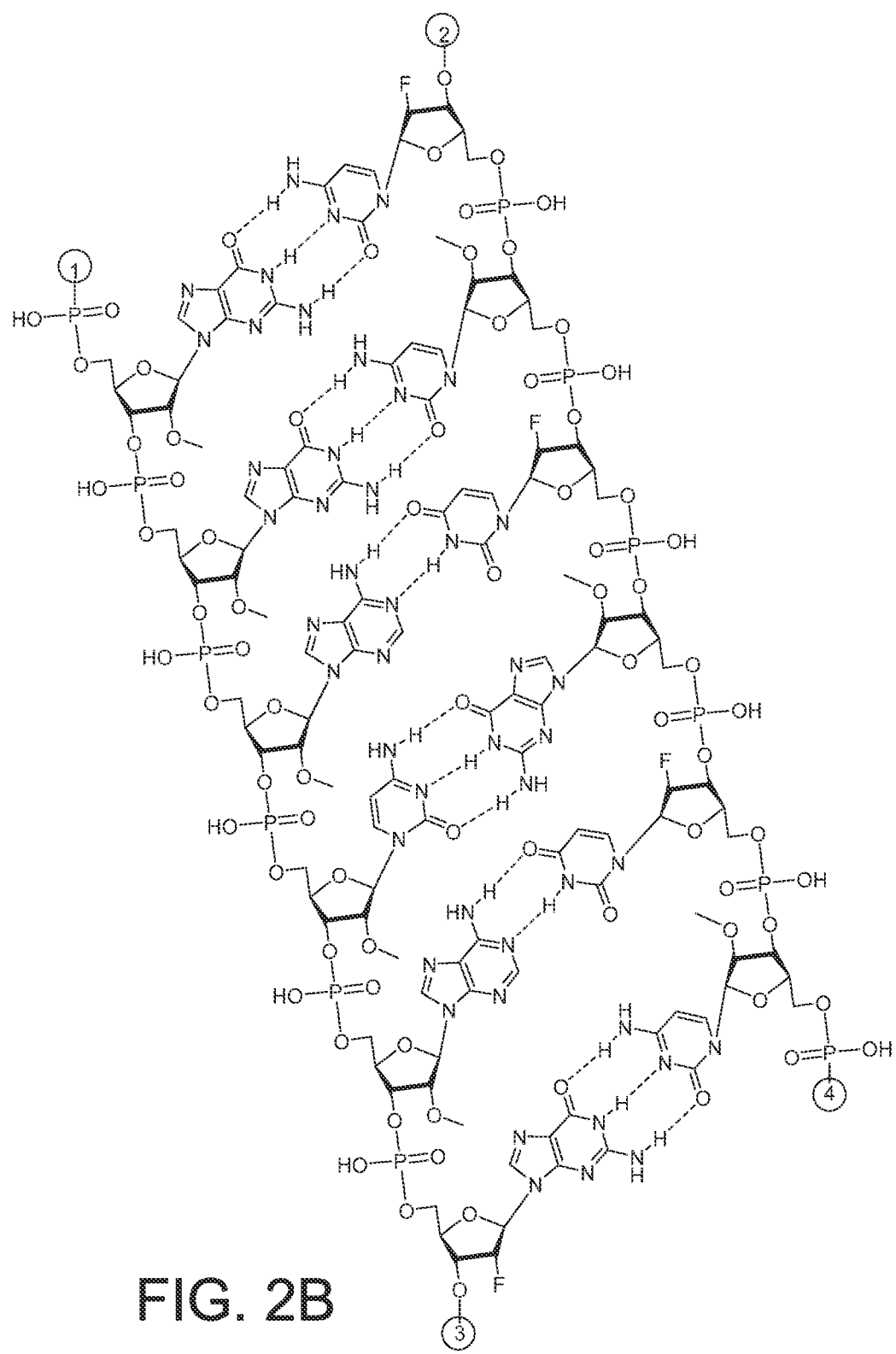
Figure 2C:
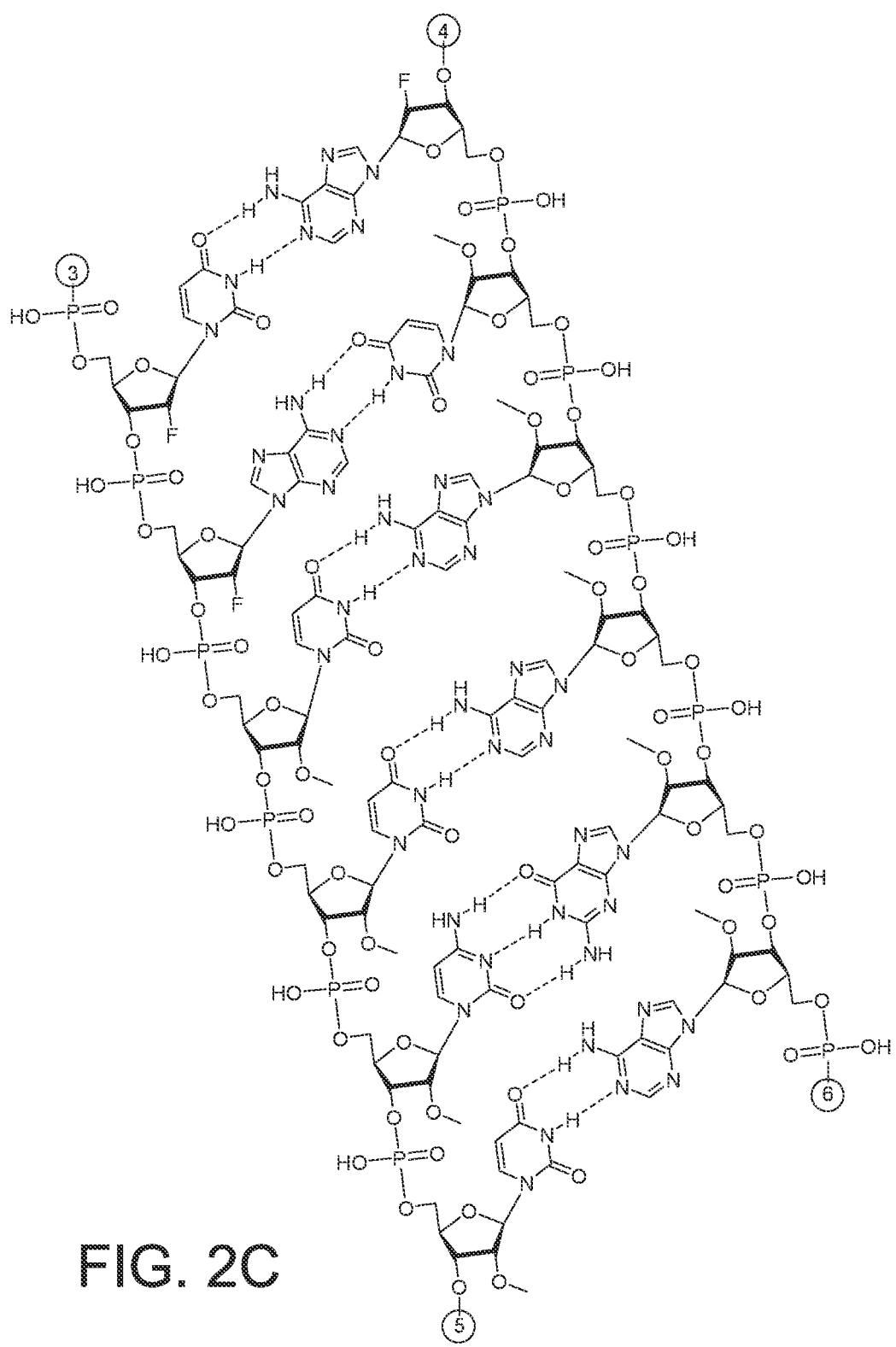
Figure 2D:
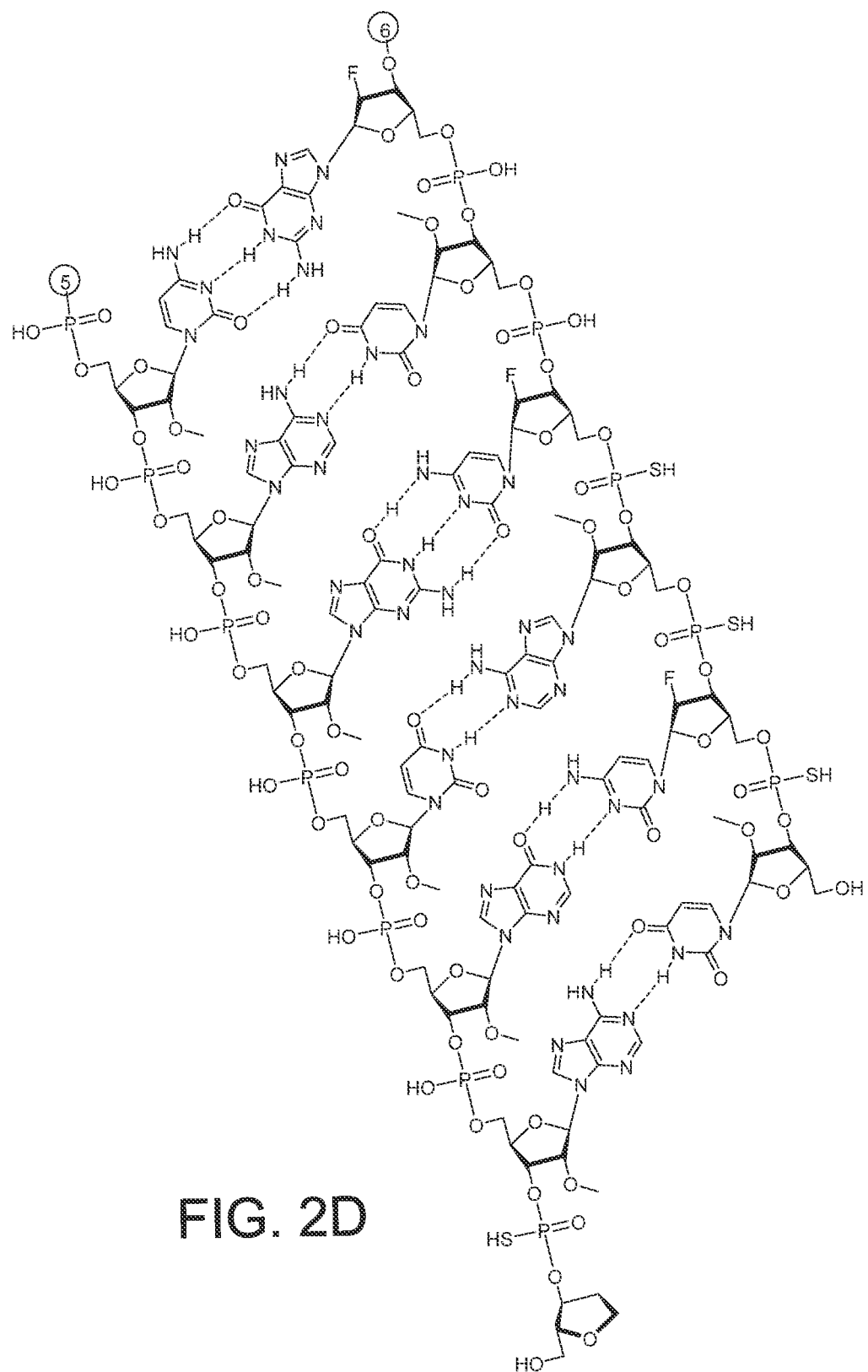

FIG. 2A to 2D. Chemical structure representation of APOC3 RNAi agent AD05251, including a tridentate N-acetyl-galactosamine-containing targeting ligand (having the structure of (NAG37)s) conjugated at the 5' terminal end of the sense strand, shown as a free acid.

Figure 3A:
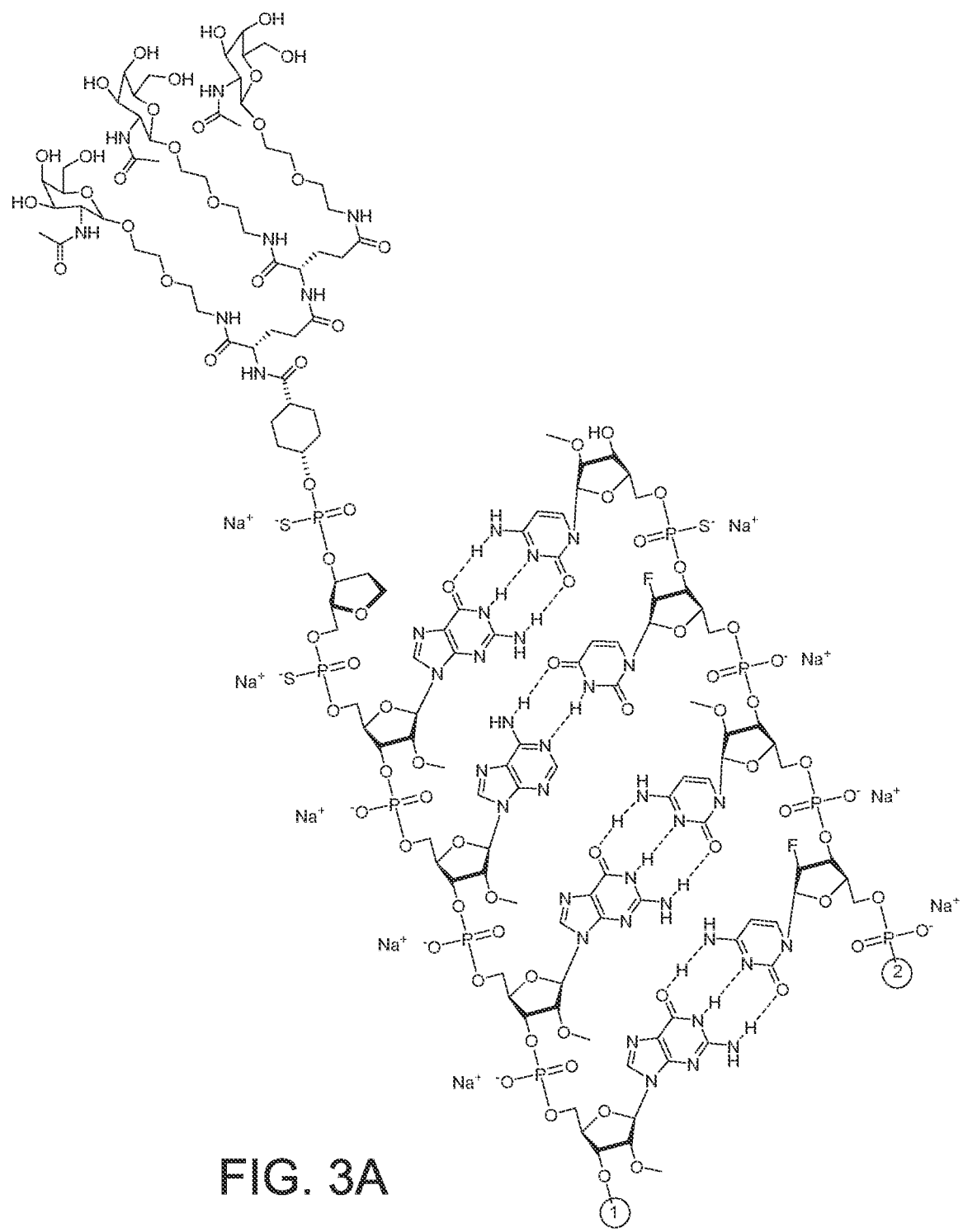
Figure 3B:
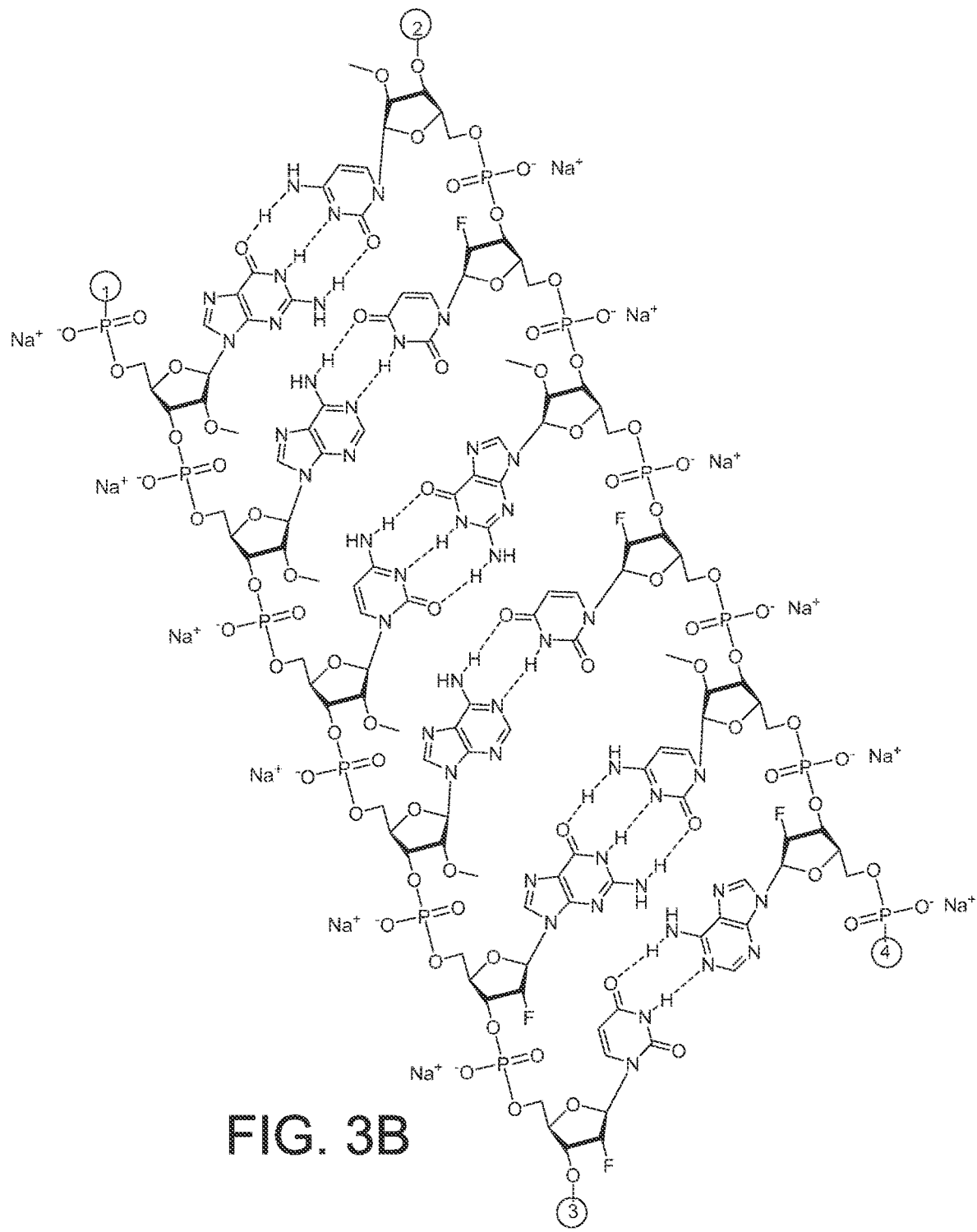
Figure 3C:
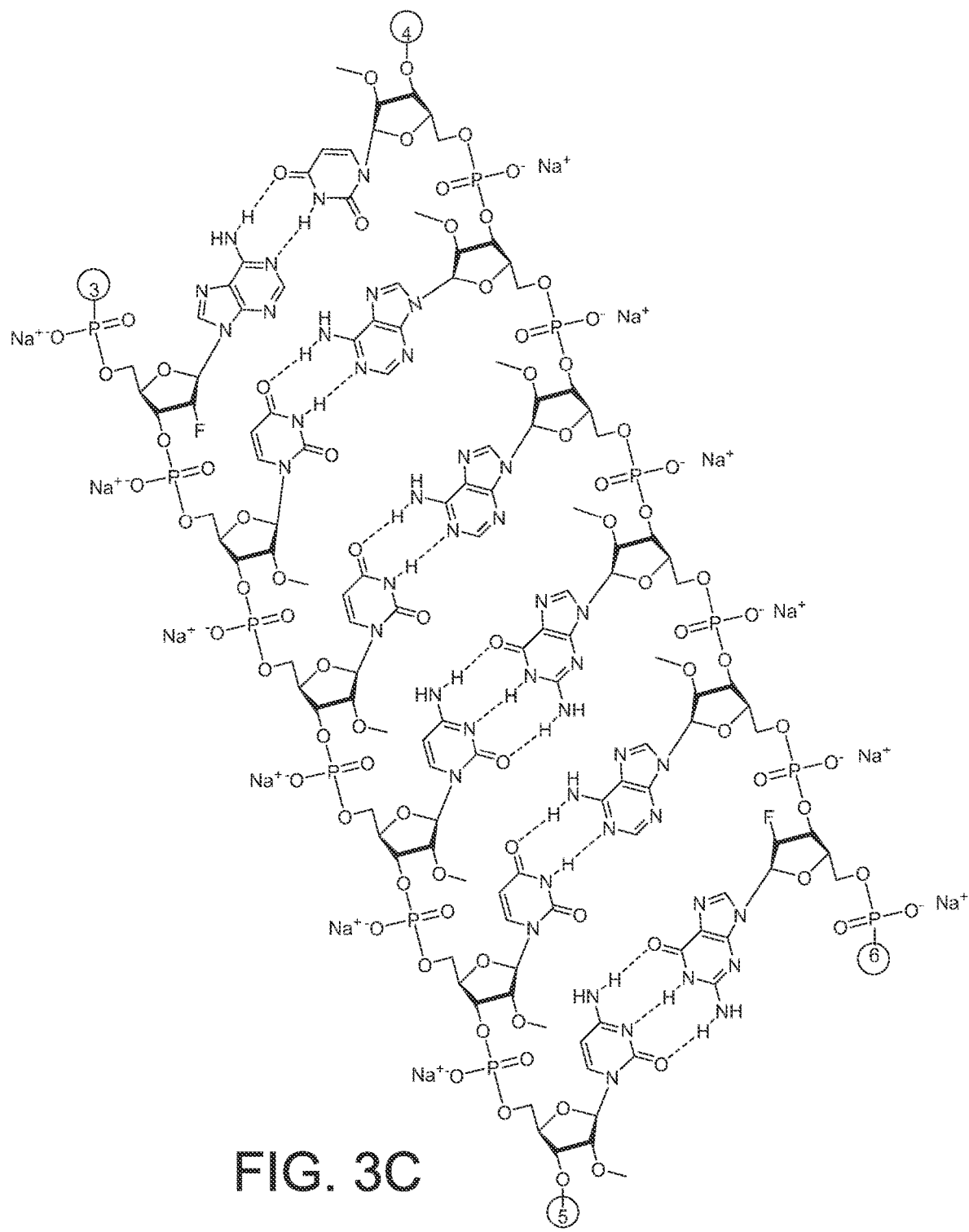
Figure 3D:
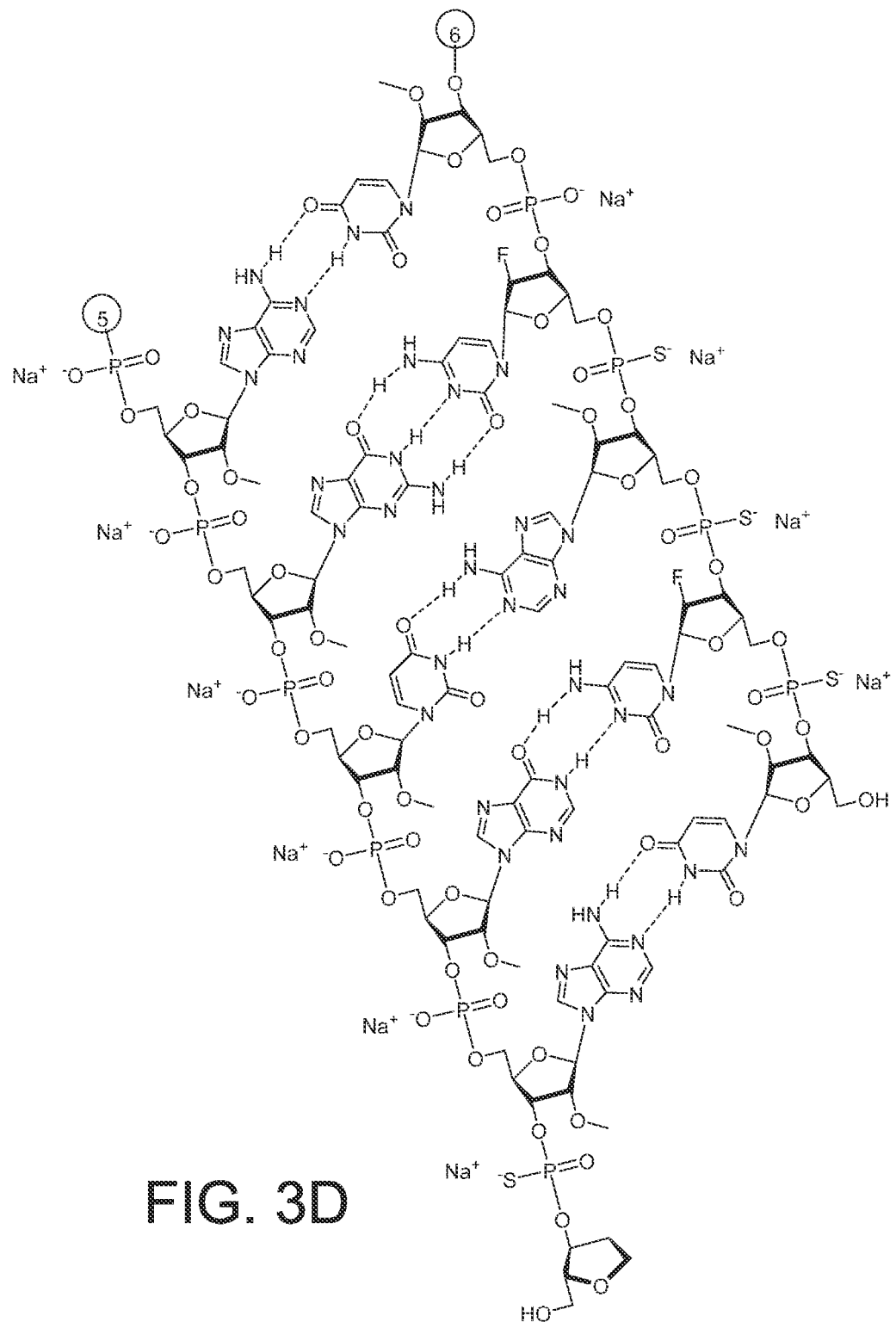

FIG. 3A to 3D. Chemical structure representation of APOC3 RNAi agent AD05251, including a tridentate N-acetyl-galactosamine-containing targeting ligand (having the structure of (NAG37)s) conjugated at the 5' terminal end of the sense strand, shown as a sodium salt.

Figure 4A:
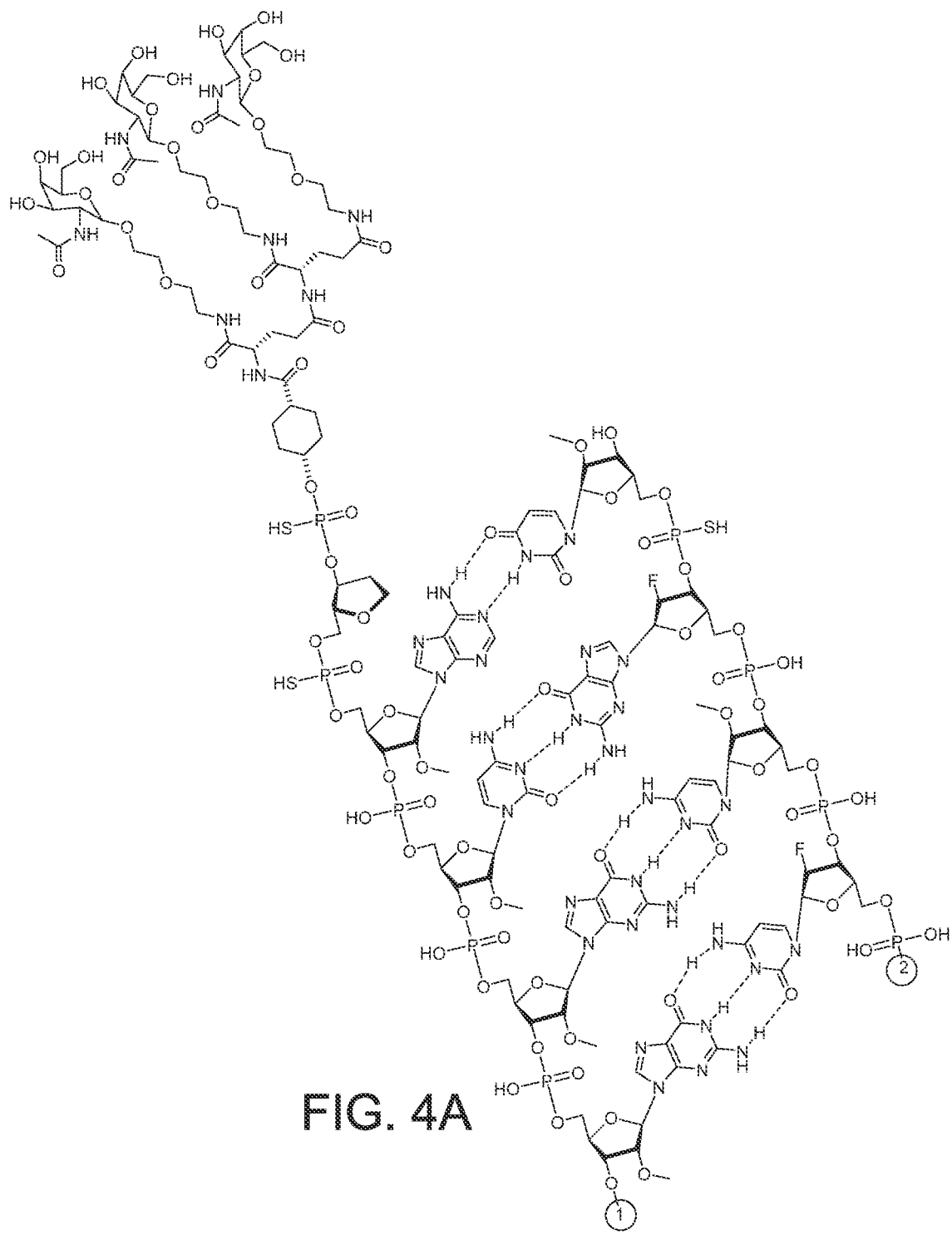
Figure 4B:
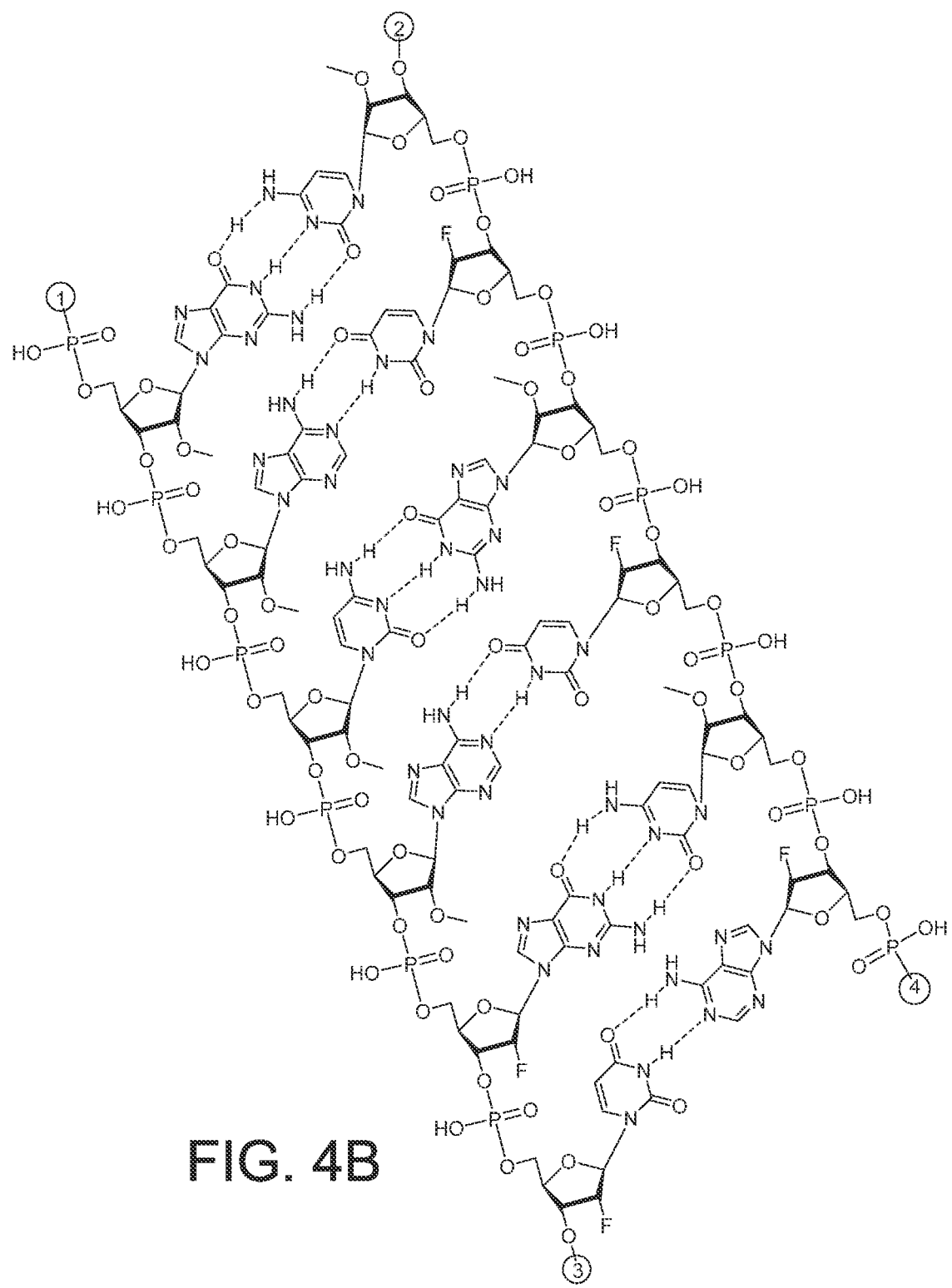
Figure 4C:
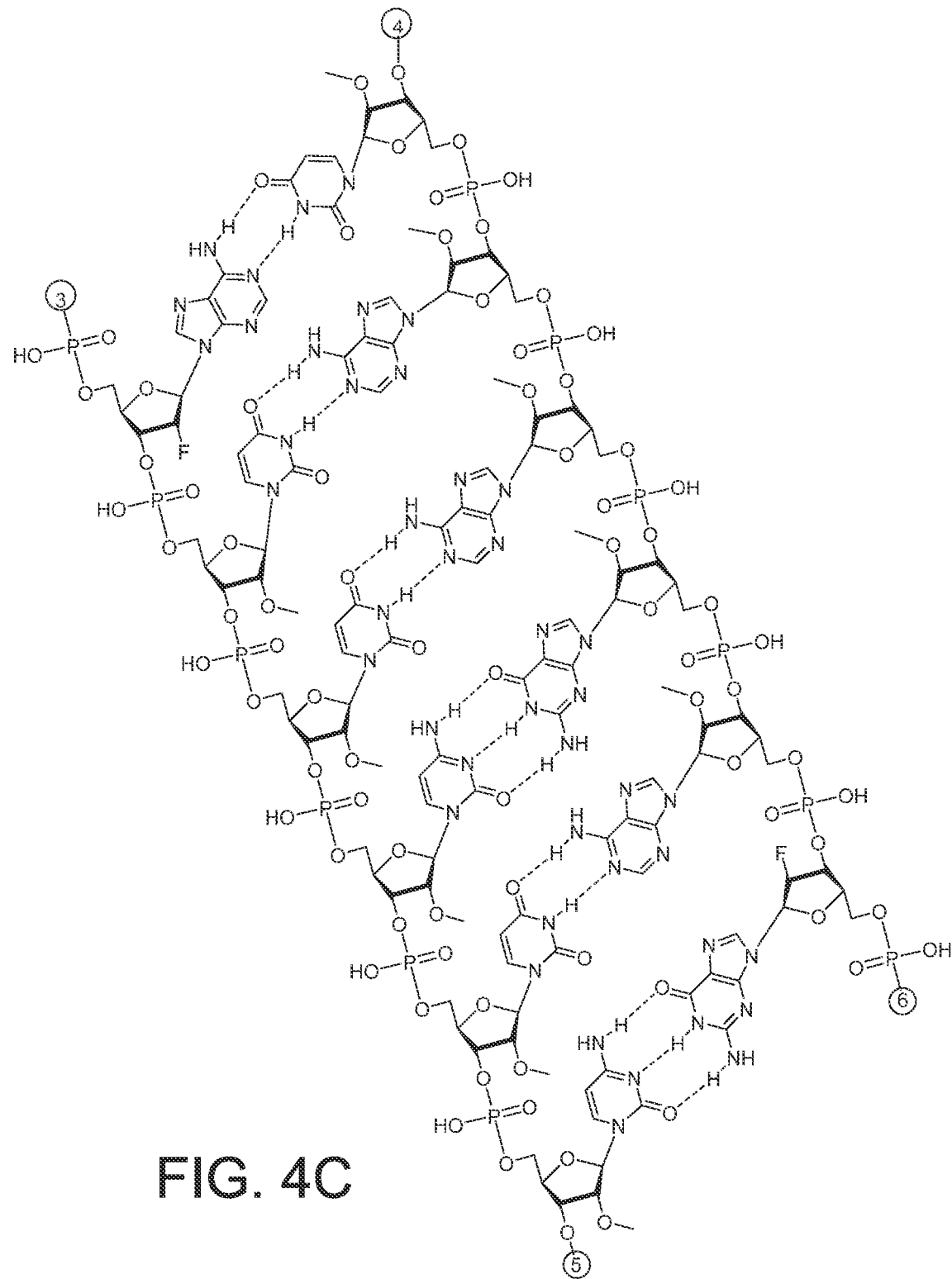
Figure 4D:
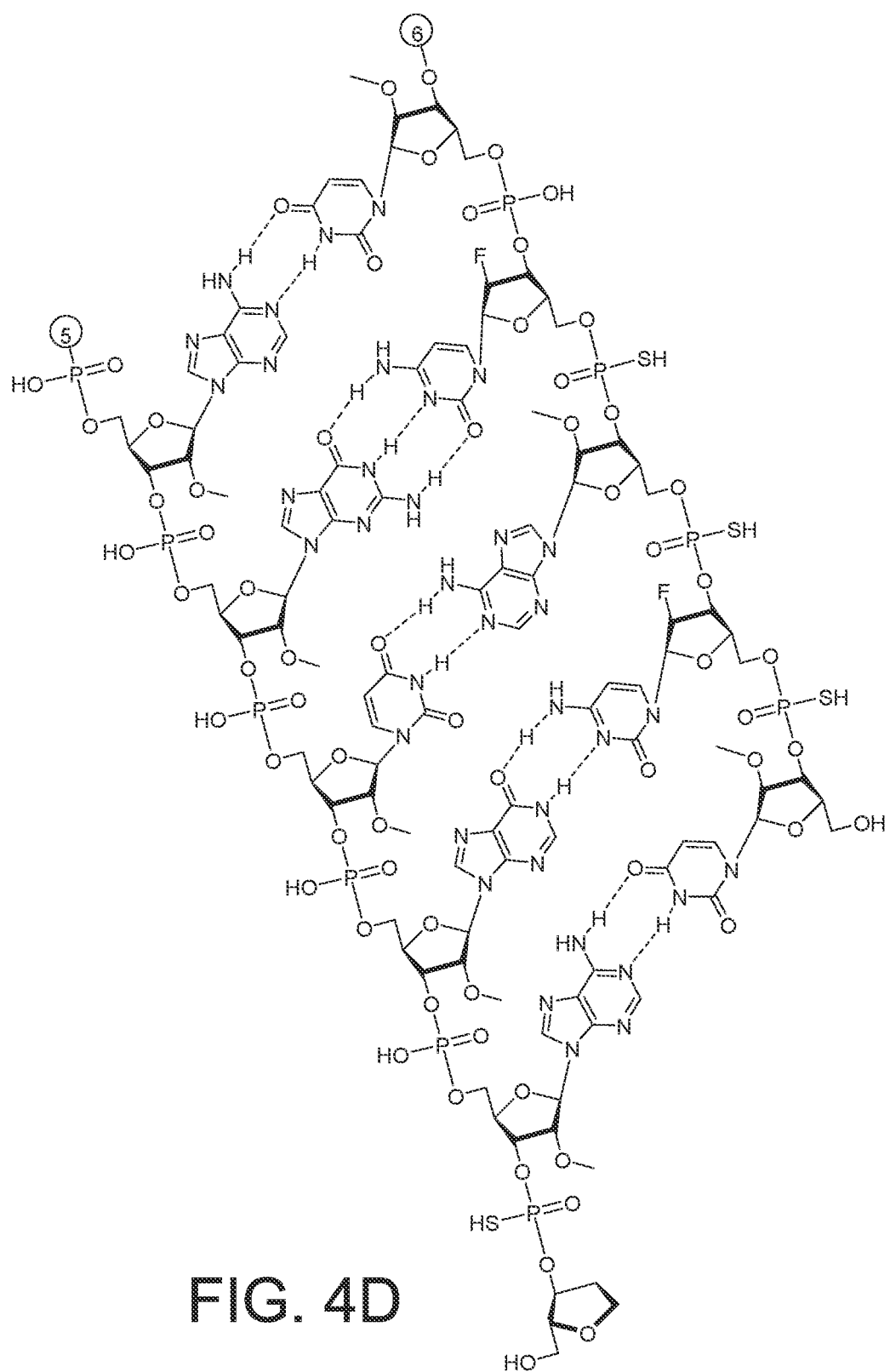

FIG. 4A to 4D. Chemical structure representation of APOC3 RNAi agent AD05876, including a tridentate N-acetyl-galactosamine-containing targeting ligand (having the structure of (NAG37)s) conjugated at the 5' terminal end of the sense strand, shown as a free acid.

Figure 5A:
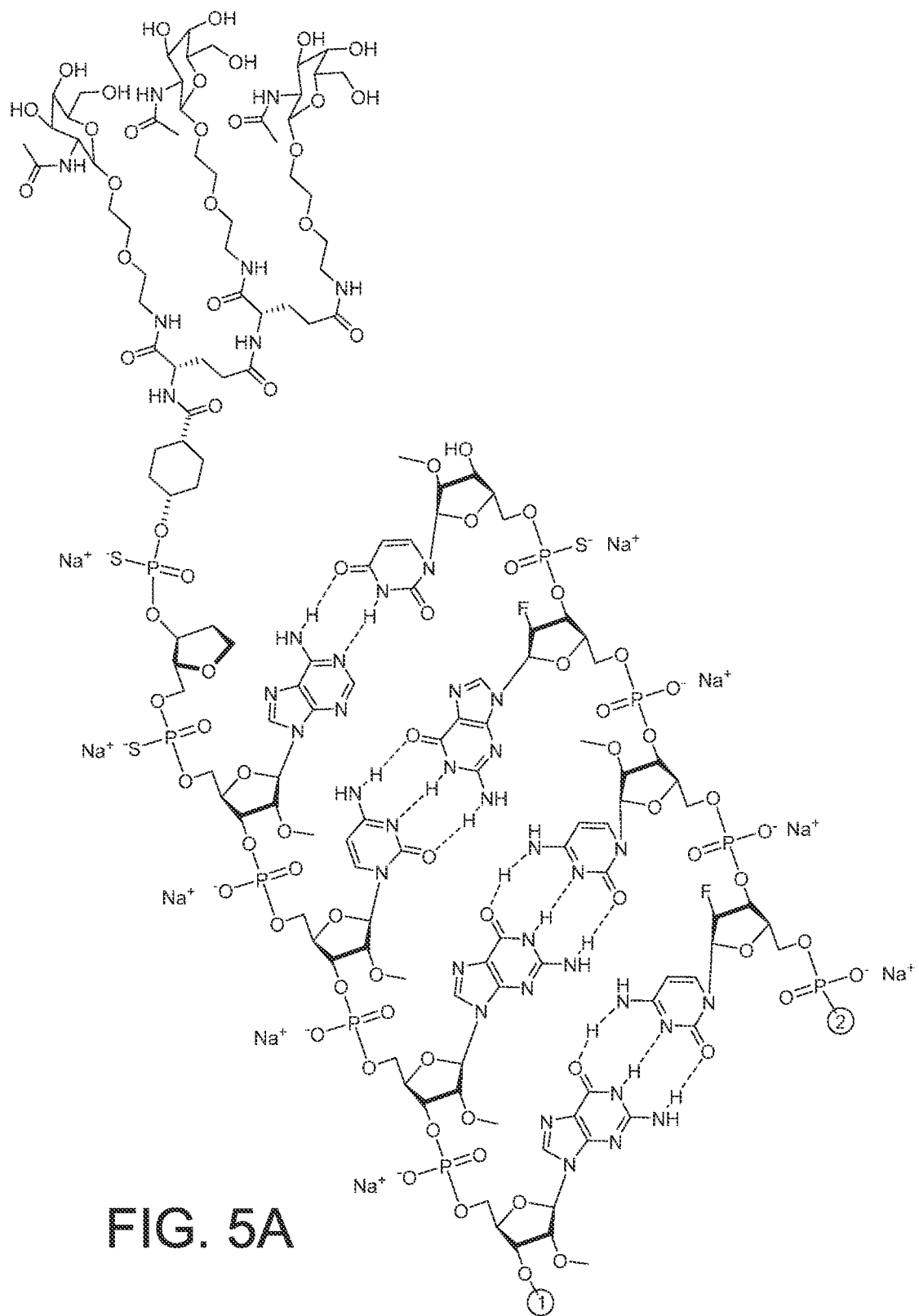
Figure 5B:
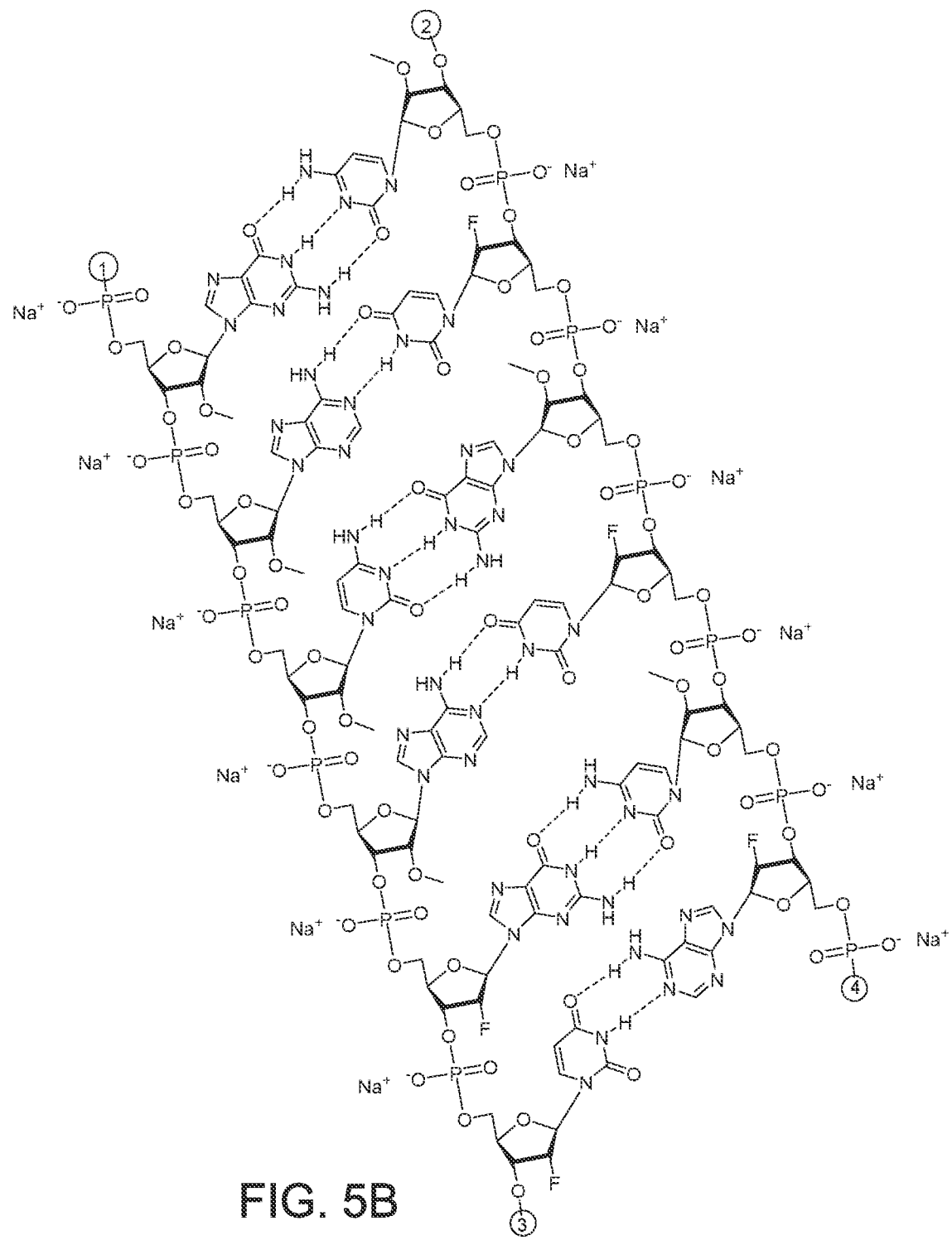
Figure 5C:
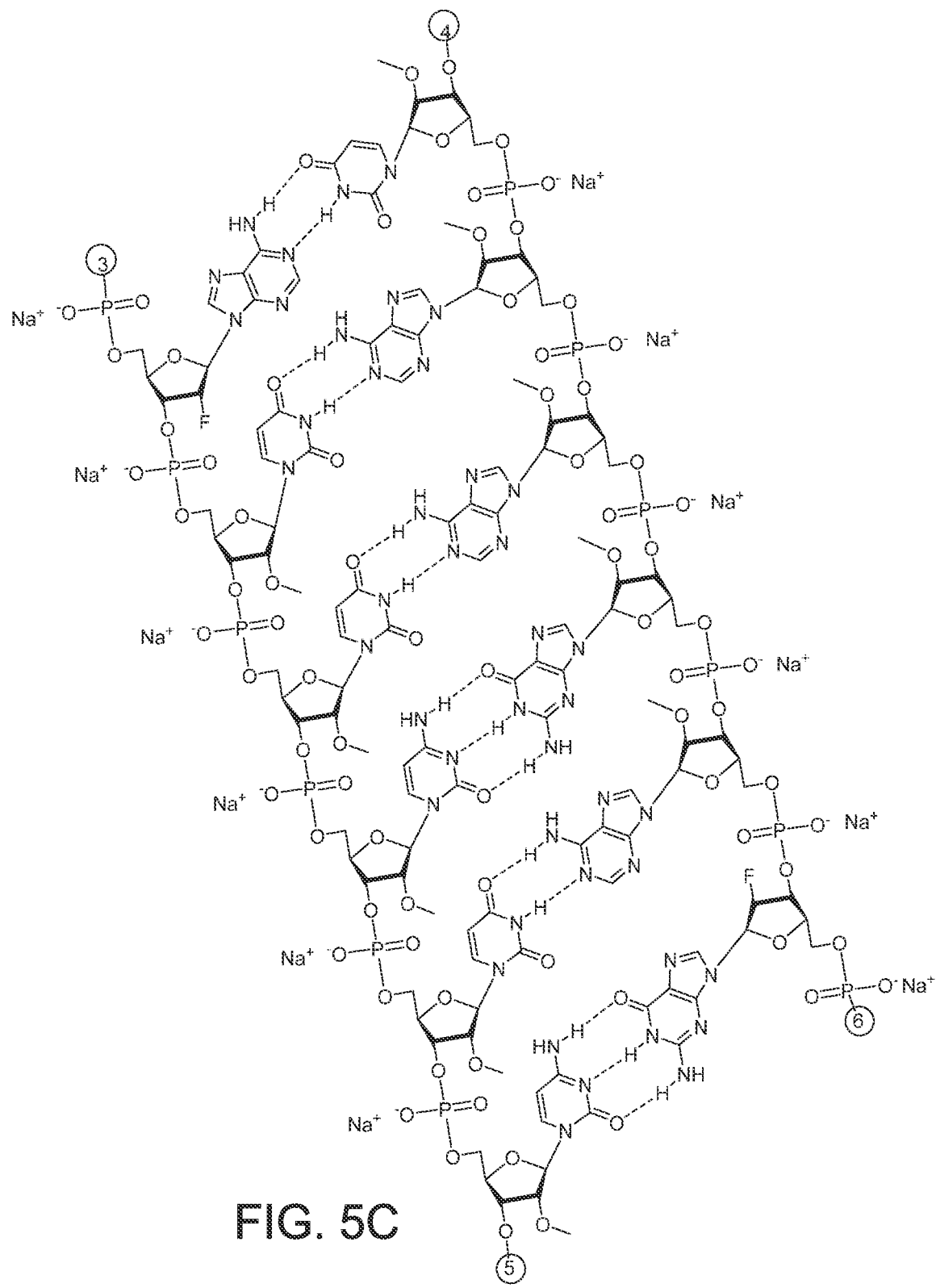
Figure 5D:
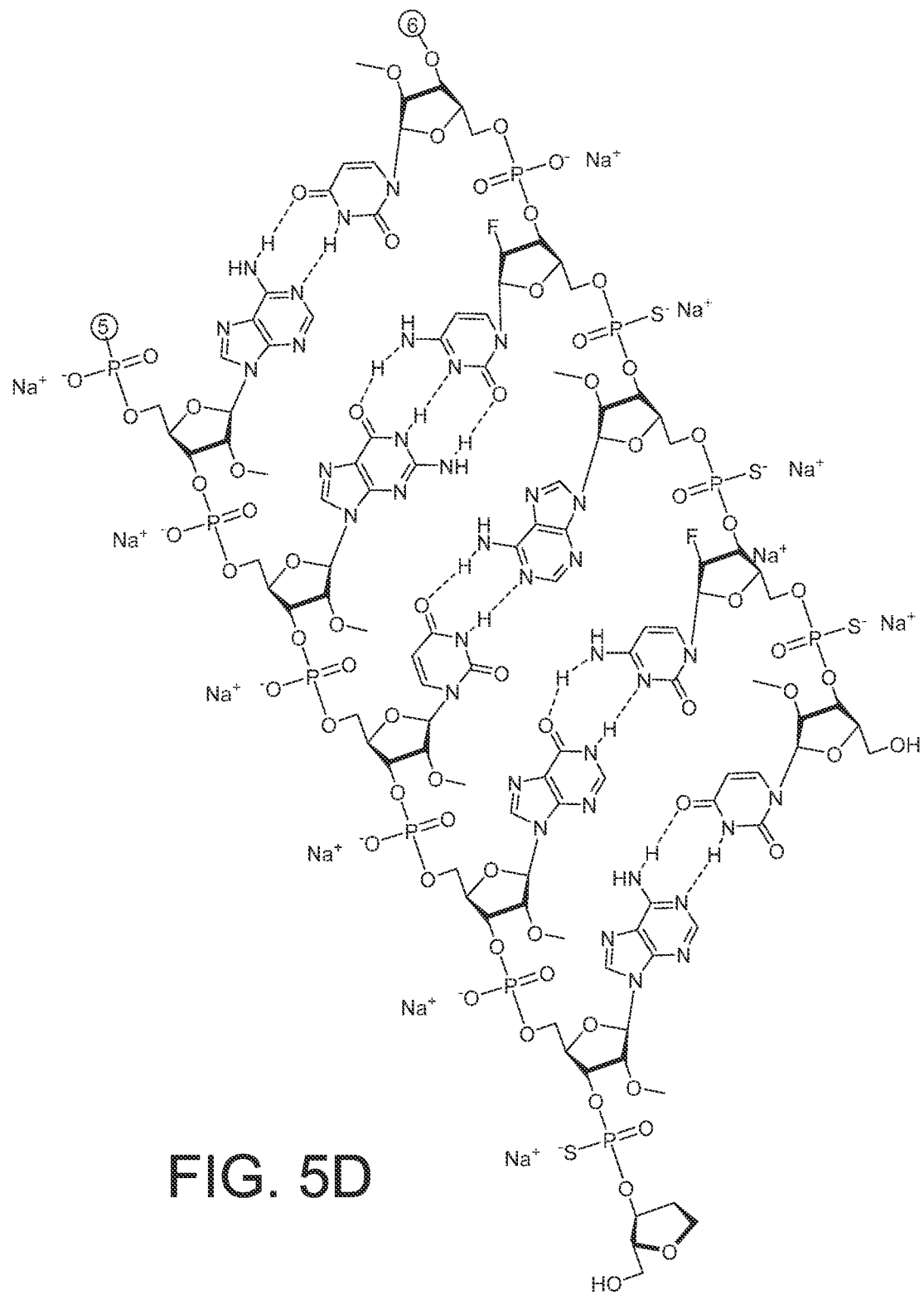

FIG. 5A to 5D. Chemical structure representation of APOC3 RNAi agent AD05876, including a tridentate N-acetyl-galactosamine-containing targeting ligand (having the structure of (NAG37)s) conjugated at the 5' terminal end of the sense strand, shown as a sodium salt.

Figure 6A:
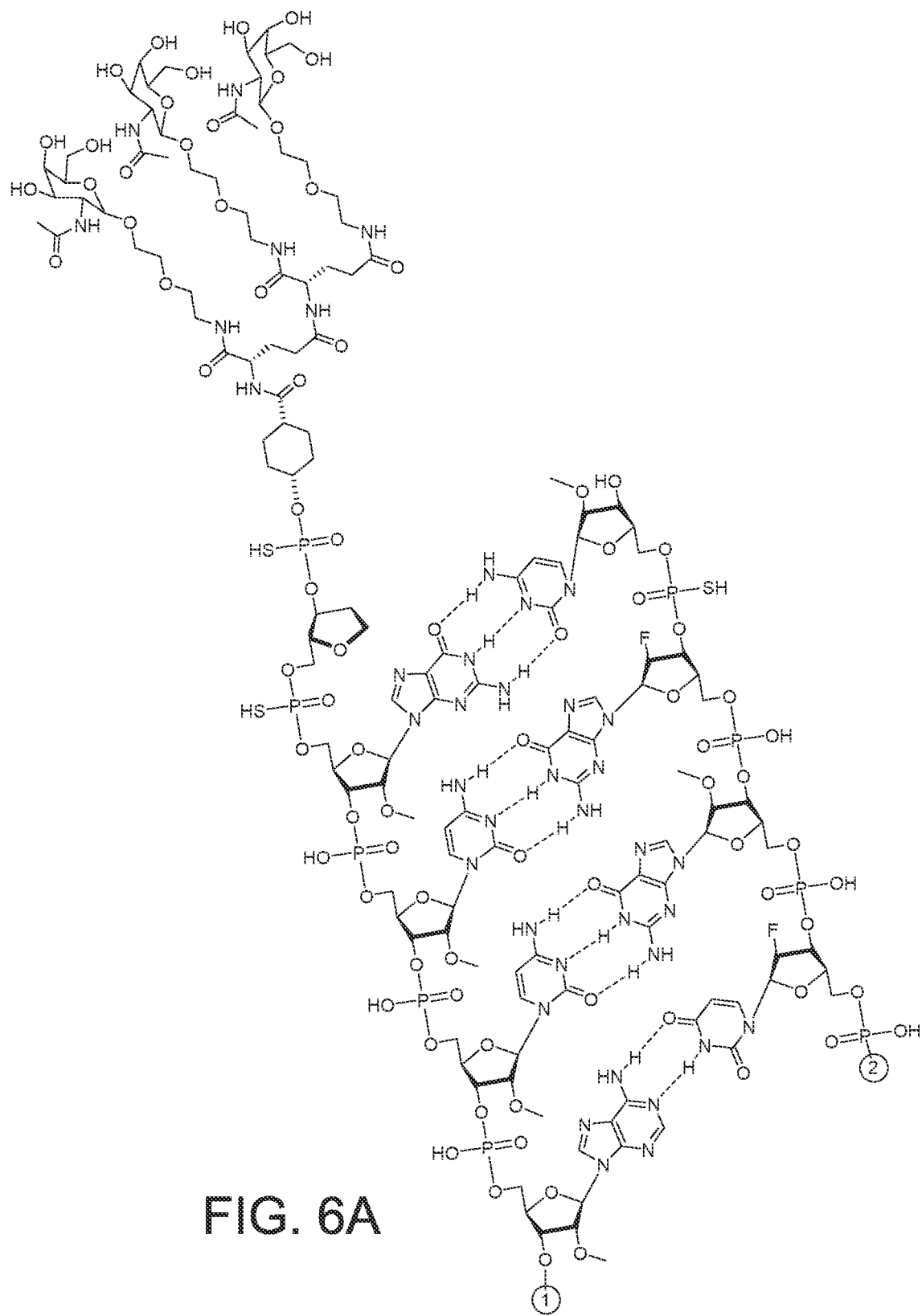
Figure 6B:
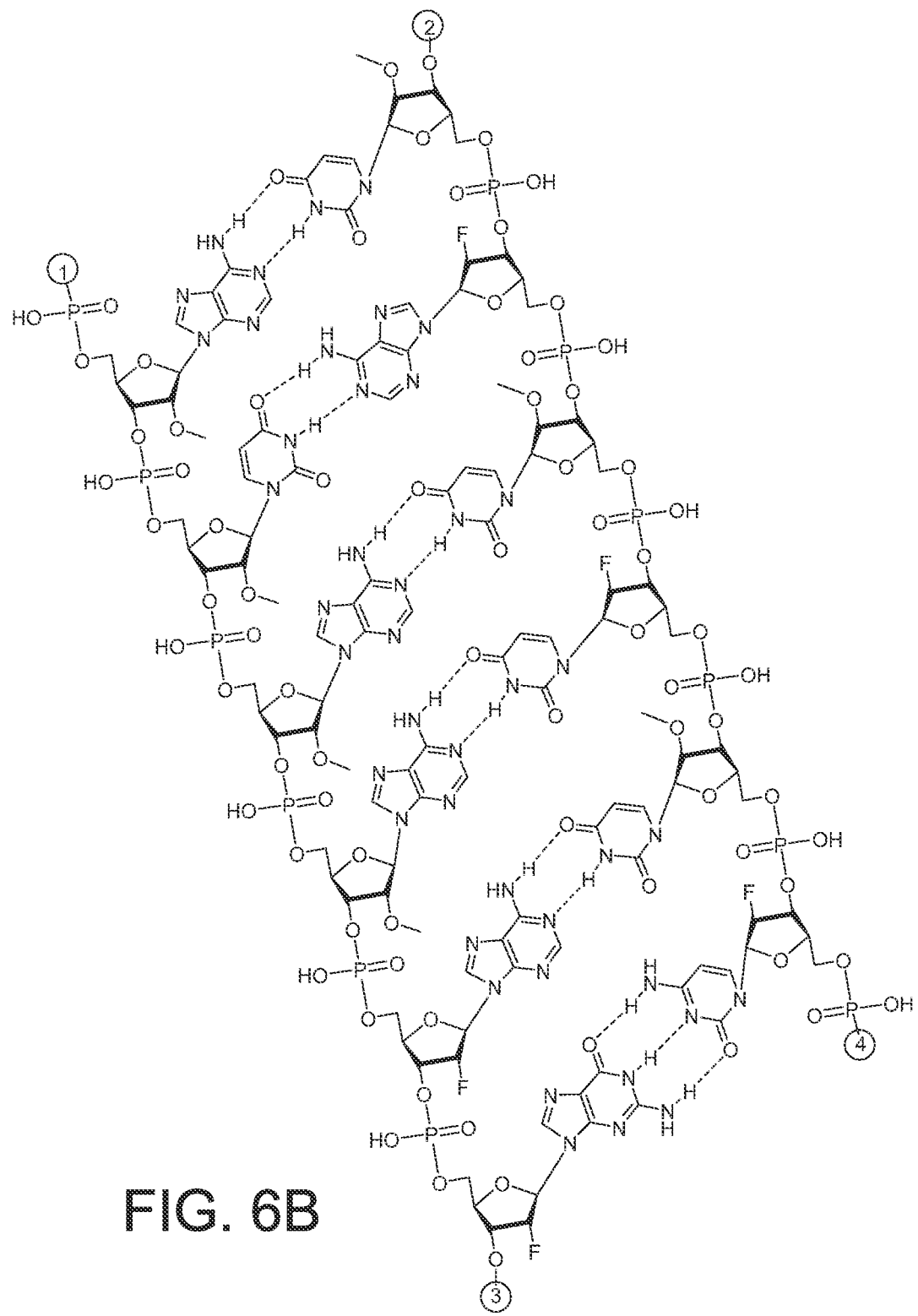
Figure 6C:
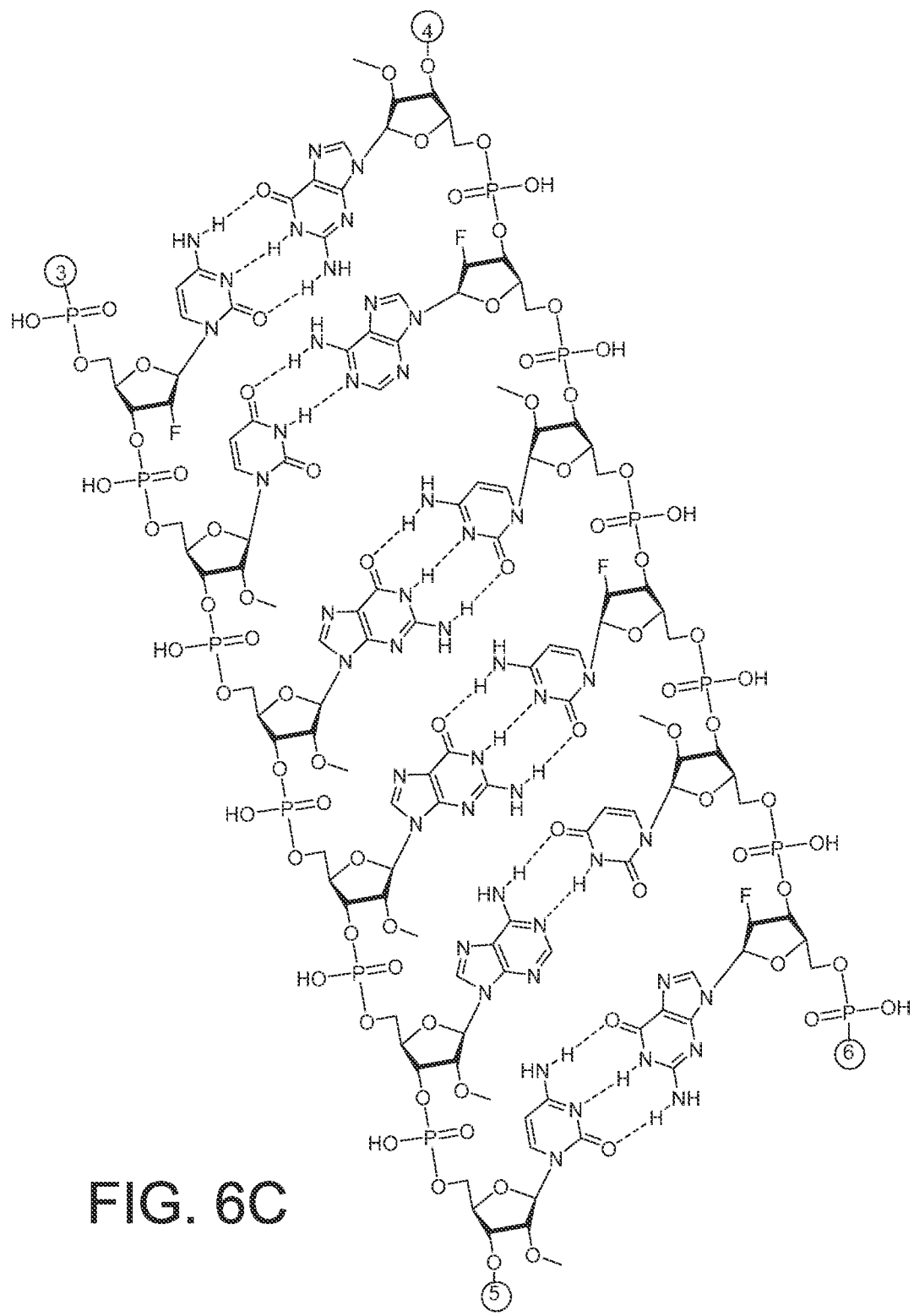
Figure 6D:
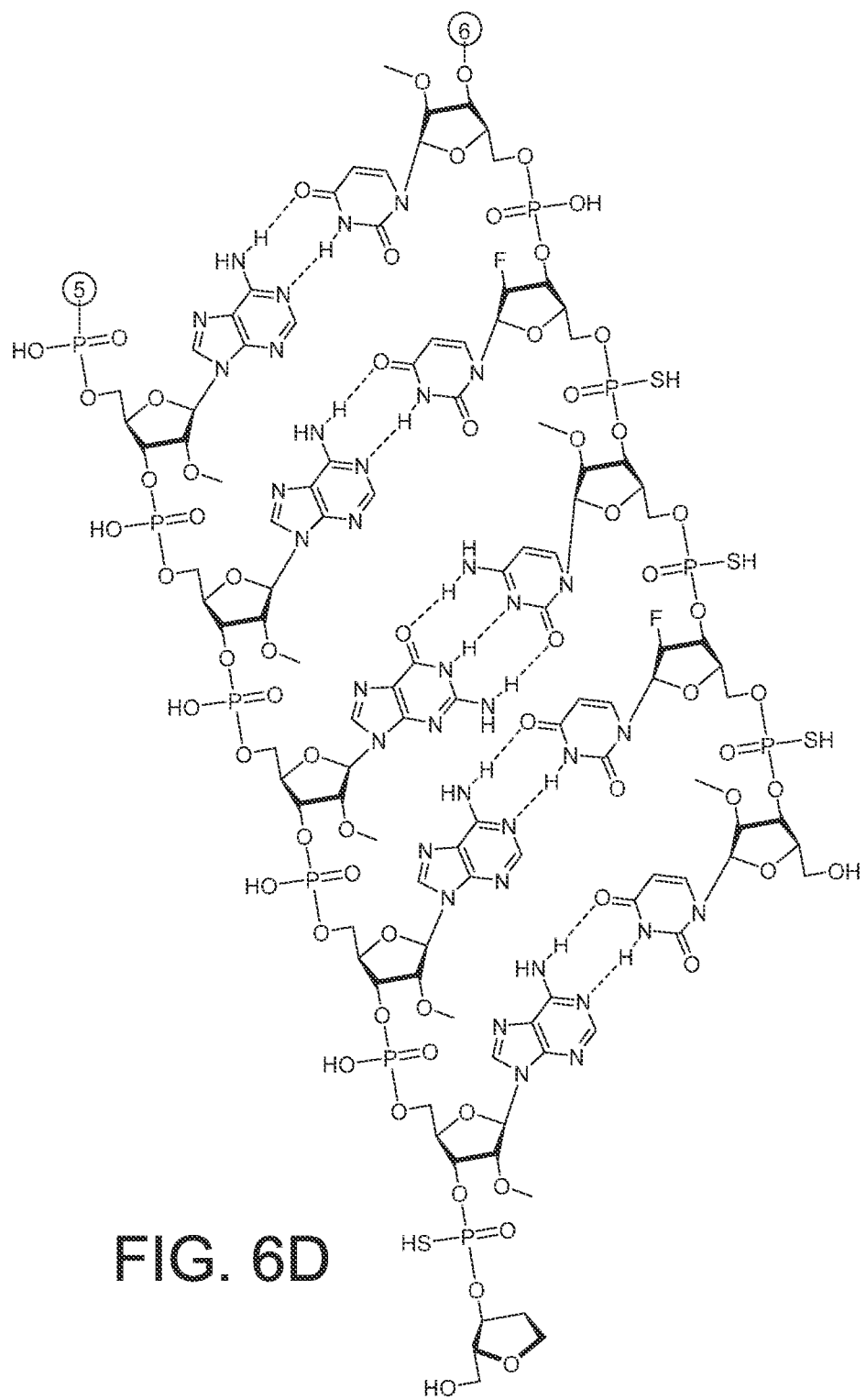

FIG. 6A to 6D. Chemical structure representation of APOC3 RNAi agent AD05220, including a tridentate N-acetyl-galactosamine-containing targeting ligand (having the structure of (NAG37)s) conjugated at the 5' terminal end of the sense strand, shown as a free acid.

Figure 7A:
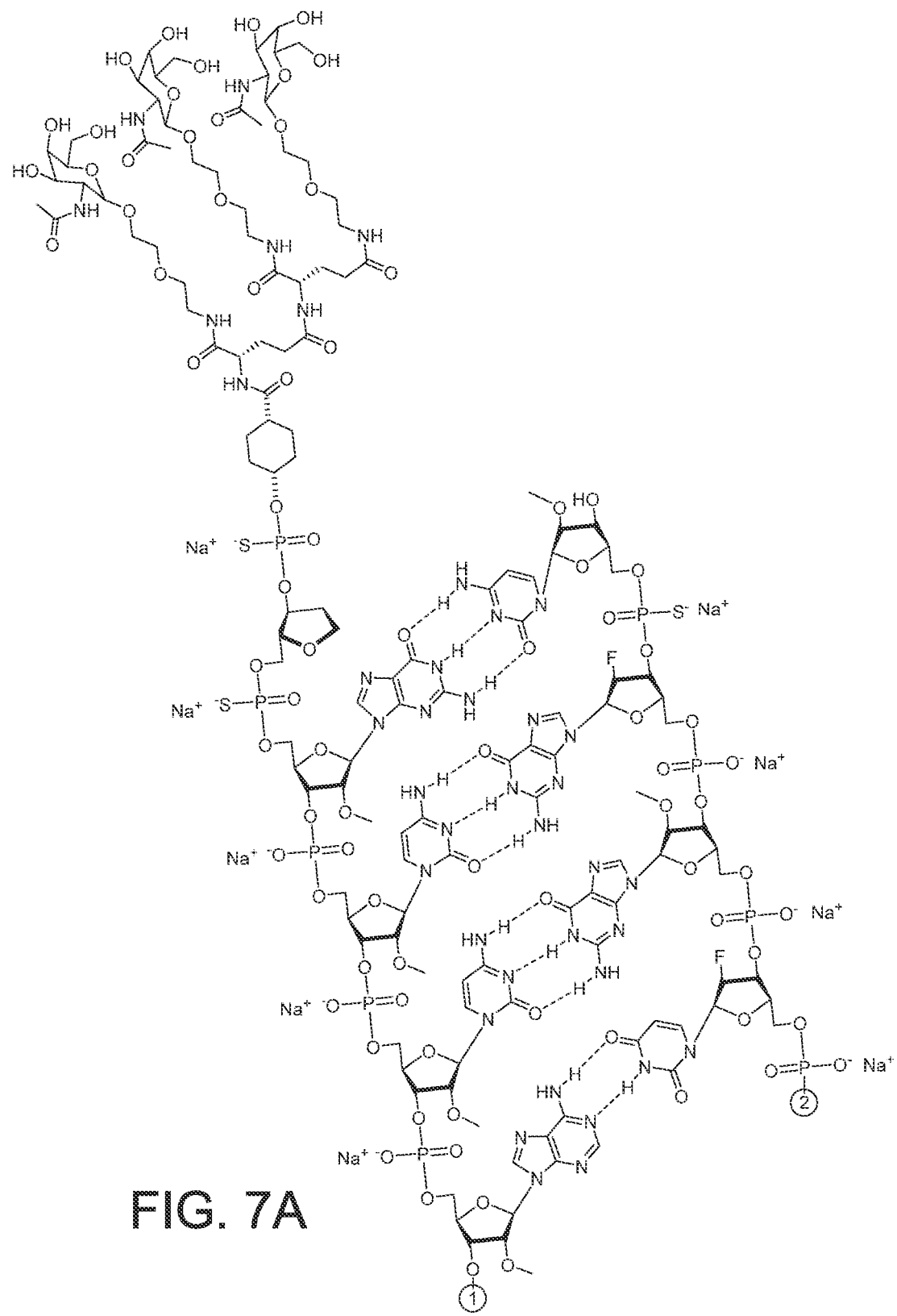
Figure 7B:
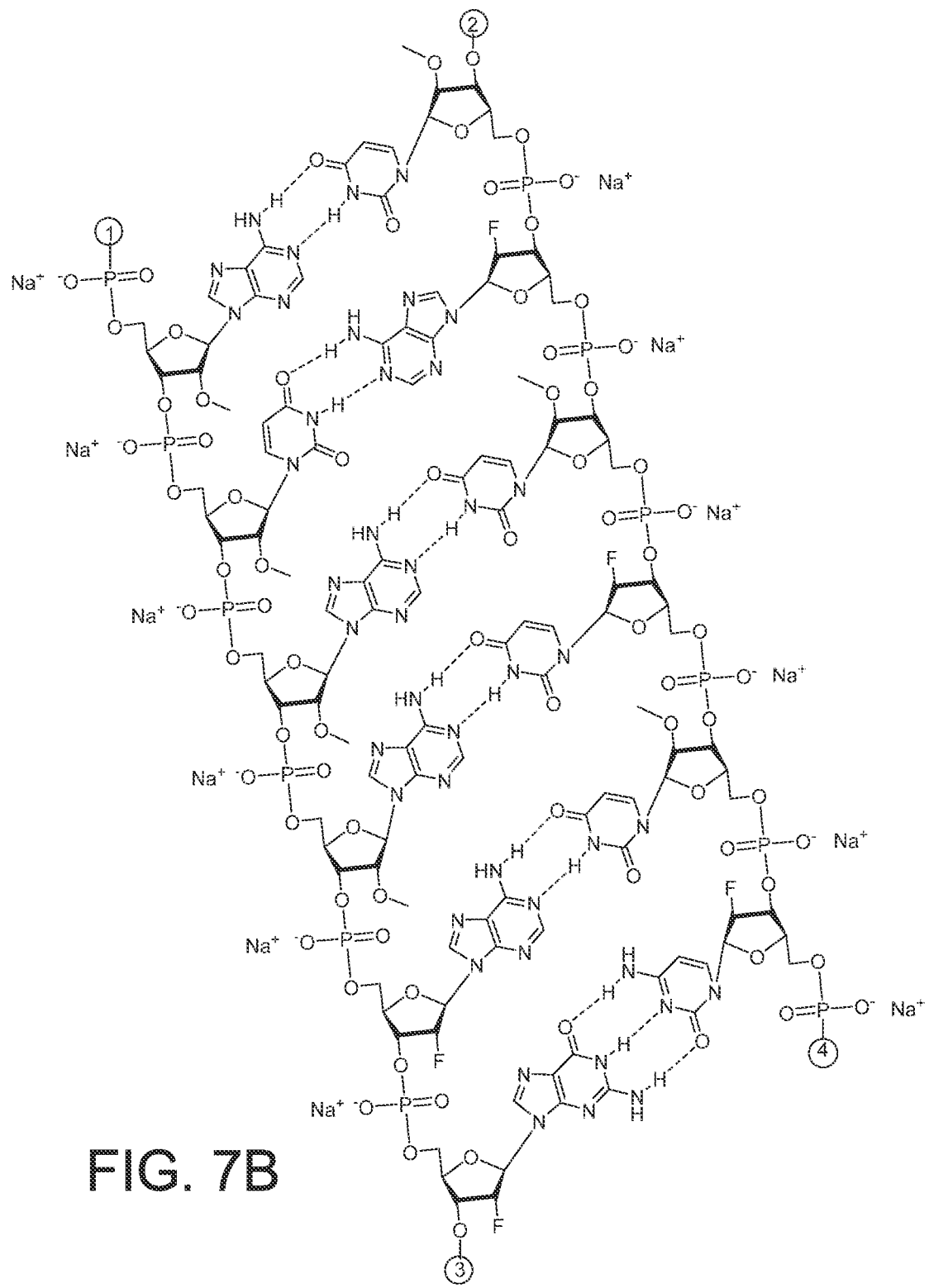
Figure 7C:
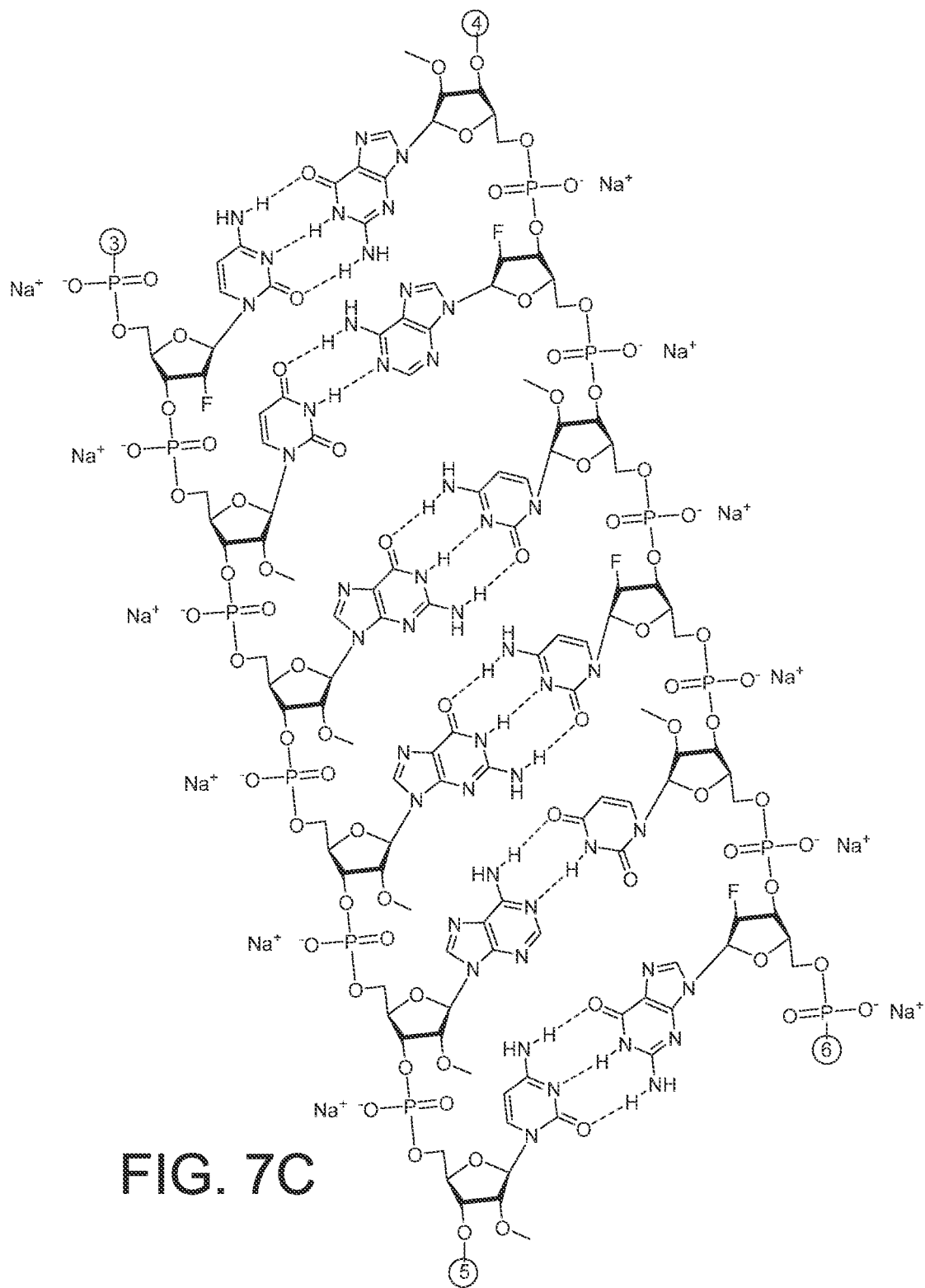
Figure 7D:
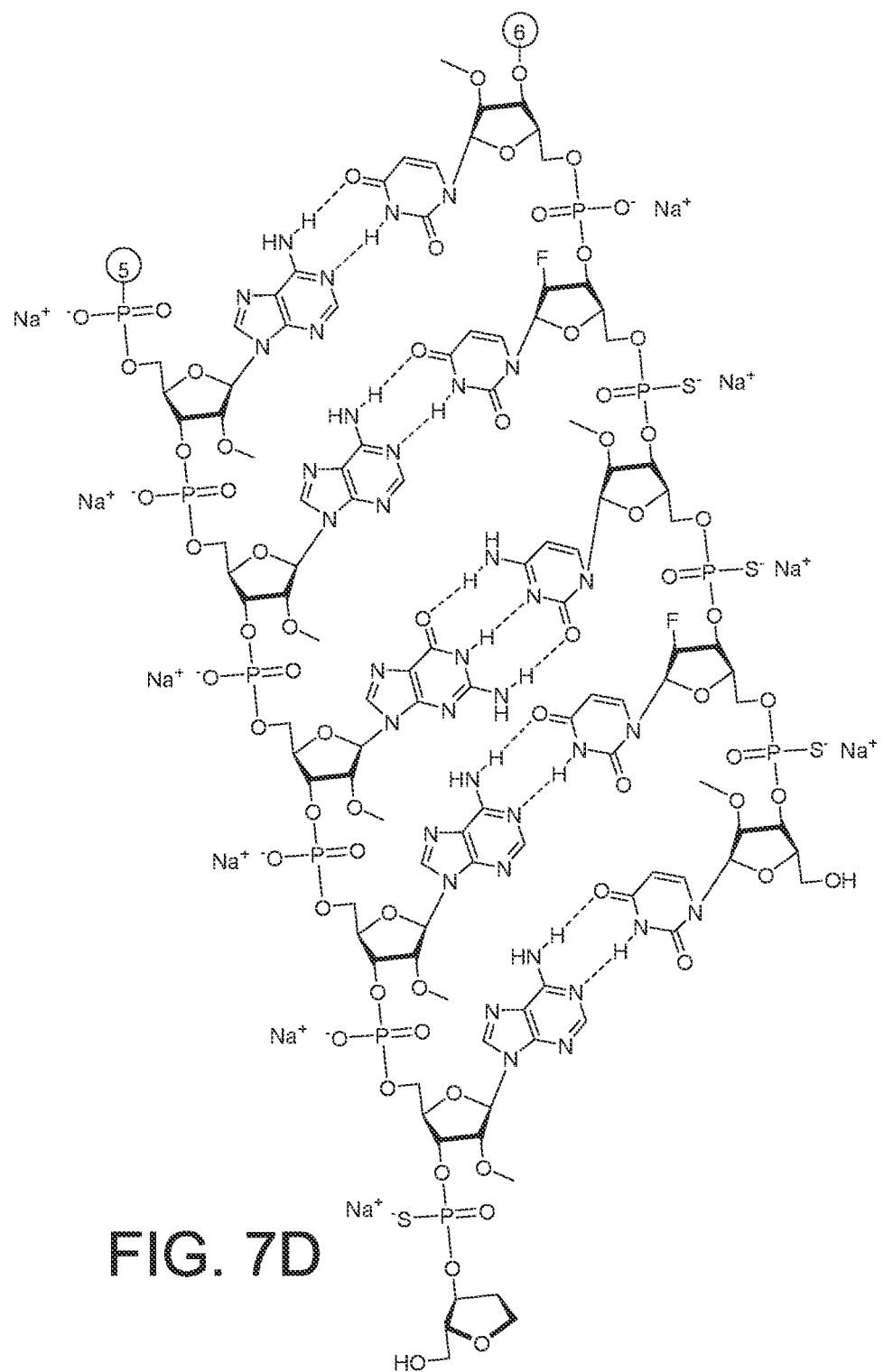

FIG. 7A to 7D. Chemical structure representation of APOC3 RNAi agent AD05220, including a tridentate N-acetyl-galactosamine-containing targeting ligand (having the structure of (NAG37)s) conjugated at the 5' terminal end of the sense strand, shown as a sodium salt.

DETAILED DESCRIPTION

RNAi Agents

RNAi agents for inhibiting expression of an APOC3 gene (referred to herein as APOC3 RNAi agents or APOC3 RNAi triggers) are described herein. Each APOC3 RNAi agent comprises a sense strand and an antisense strand. The sense strand and the antisense strand each can be 16 to 30 nucleotides in length. The sense and antisense strands can be either the same length or they can be different lengths. In some embodiments, the sense and antisense strands are each independently 17 to 27 nucleotides in length. In some embodiments, the sense and antisense strands are each independently 17-21 nucleotides in length. In some embodiments, the sense and antisense strands are each 21-26 nucleotides in length. In some embodiments, the sense and antisense strands are each 21-24 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent sense and antisense strands are each independently 17, 18, 19, 20, 21, 22, 23, 24, 25, or 26 nucleotides in length. In some embodiments, a double-stranded RNAi agent has a duplex length of about 16, 17, 18, 19, 20, 21, 22, 23 or 24 nucleotides.

In some embodiments, the region of perfect, substantial, or partial complementarity between the sense strand and the antisense strand is 16-26 (e.g., 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

The sense strand and antisense strand each contain a core stretch (also referred to herein as a "core sequence" or a "core stretch sequence") that is 16 to 23 nucleotides in length. An antisense strand core stretch is 100% (perfectly) complementary or at least about 85% (substantially) complementary to a nucleotide sequence (sometimes referred to, e.g., as a target sequence) present in the APOC3 mRNA target. A sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence (target sequence) present in the APOC3 mRNA target. A sense strand core stretch sequence can be the same length as a corresponding antisense core sequence or it can be a different length. In some embodiments, the antisense strand core stretch sequence is 16, 17, 18, 19, 20, 21, 22, or 23 nucleotides in length. In some embodiments, the sense strand core stretch sequence is 16, 17, 18, 19, 20, 21, 22, or 23 nucleotides in length.

Examples of sense and antisense strand nucleotide sequences used in forming APOC3 RNAi agents are provided in Tables 2, 3, 4, and 5. Examples of RNAi agent duplexes, that include the sense strand and antisense strand sequences in Tables 2, 4, and 5, are shown in Table 6.

The APOC3 RNAi agent sense and antisense strands anneal to form a duplex. A sense strand and an antisense strand of an APOC3 RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 16, at least 17, at least 18, at least 19, at least 20, at least 21, at least 22, or at least 23 nucleotides that is at least 85% or 100% complementary to a corresponding 16, 17, 18, 19, 20, 21, 22, or 23 nucleotide sequence of the antisense strand core stretch sequence (i.e., the sense and antisense core stretch sequences of an APOC3 RNAi agent have a region of at least 16, at least 17, at least 18, at least 19, at least 20, at least 21, at least 22, or at least 23 nucleotides that is at least 85% base paired or 100% base paired.)

In some embodiments, the antisense strand of an APOC3 RNAi agent disclosed herein differs by 0, 1, 2, or 3 nucleotides from any of the antisense strand sequences in Table 2, Table 3, or Table 4. In some embodiments, the sense strand of an APOC3 RNAi agent disclosed herein differs by 0, 1, 2, or 3 nucleotides from any of the sense strand sequences in Table 2, Table 3, or Table 5.

The sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the APOC3 mRNA. The sense strand additional nucleotides, if present, may or may not be identical to the corresponding sequence in the APOC3 mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, an APOC3 RNAi agent has an antisense strand having a 3' extension and a sense strand having a 5' extension. In some embodiments, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some embodiments, an APOC3 RNAi agent comprises an antisense strand having a 3' extension of 1, 2, 3, 4, 5, or 6 nucleotides in length. In other embodiments, an APOC3 RNAi agent comprises an antisense strand having a 3' extension of 1, 2, or 3 nucleotides in length. In some embodiments, one or more of the antisense strand extension nucleotides comprise uracil or thymidine nucleotides or nucleotides that are complementary to the corresponding APOC3 mRNA sequence.

In some embodiments, the 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. (See, e.g., U.S. Pat. No. 5,998,203). In some embodiments, Ab or AbAb can be added to the 3' end of the antisense strand.

In some embodiments, the sense strand or the antisense strand may include a "terminal cap," which as used herein is a non-nucleotide compound or other moiety that can be incorporated at one or more termini of a strand of an RNAi agent disclosed herein, and can provide the RNAi agent, in some instances, with certain beneficial properties, such as, for example, protection against exonuclease degradation. In some embodiments, inverted abasic residues (invAb) are added as terminal caps (see Table 76). (See, e.g., F. Czauderna, Nucleic Acids Res., 2003, 31(11), 2705-16). Terminal caps are generally known in the art, and include, for example, inverted abasic residues as well as carbon chains such as a terminal C3, C6, or C12 groups. In some embodiments, a terminal cap is present at either the 5' terminal end, the 3' terminal end, or both the 5' and 3' terminal ends of the sense strand.

In some embodiments, an APOC3 RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to nucleotides in the APOC3 mRNA sequence. In some embodiments, the 3' sense strand extension includes or consists of one of the following sequences, but is not limited to: T, UT, TT, UU, UUT, TTT, or TTTT (each listed 5' to 3').

In some embodiments, the 3' end of the sense strand may include additional abasic residues or inverted abasic terminal caps. In some embodiments, UUAb, UAb, or Ab are added to the 3' end of the sense strand.

In some embodiments, one or more inverted abasic residues (invAb) are added to the 3' end of the sense strand. In some embodiments, one or more inverted abasic residues or inverted abasic sites are inserted between the targeting ligand and the nucleobase sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, an APOC3 RNAi agent comprises a sense strand having a 5' extension of 1, 2, 3, 4, 5, or 6 nucleotides in length. In some embodiments, one or more of the sense strand extension nucleotides comprise uracil or adenosine nucleotides or nucleotides that correspond to nucleotides in the APOC3 mRNA sequence. In some embodiments, the sense strand 5' extension is one of the following sequences, but is not limited to: CA, AUAGGC, AUAGG, AUAG, AUA, A, AA, AC, GCA, GGCA, GGC, UAUCA, UAUC, UCA, UAU, U, UU (each listed 5' to 3'). A sense strand can have a 3' extension and/or a 5' extension.

In some embodiments, the 5' end of the sense strand can include one or more additional abasic residues (e.g., (Ab) or (AbAb)). In some embodiments, one or more inverted abasic residues (invAb) are added to the 5' end of the sense strand. In some embodiments, one or more inverted abasic residues can be inserted between the targeting ligand and the nucleobase sequence of the sense strand of the RNAi agent. In some embodiments, the inclusion of one or more inverted abasic residues at or near the terminal end or terminal ends of the sense strand of an RNAi agent may allow for enhanced activity or other desired properties of an RNAi agent. In some embodiments, an abasic (deoxyribose) residue can be replaced with a ribitol (abasic ribose) residue.

In some embodiments, the 3' end of the antisense strand core stretch sequence, or the 3' end of the antisense strand sequence, may include an inverted abasic residue (invAb (see Table 7)).

Examples of sequences used in forming APOC3 RNAi agents are provided in Tables 2, 3, 4, and 5. In some embodiments, an APOC3 RNAi agent antisense strand includes a sequence of any of the sequences in Tables 2, 3, or 4. In certain embodiments, an APOC3 RNAi agent antisense strand comprises or consists of any one of the modified sequences in Table 4. In some embodiments, an APOC3 RNAi agent antisense strand includes the sequence of nucleotides (from 5' end→3' end) 1-17, 2-15, 2-17, 1-18, 2-18, 1-19, 2-19, 1-20, 2-20, 1-21, 2-21, 1-22, 2-22, 1-23, 2-23, 1-24, or 2-24 of any of the sequences in Tables 2 or 4. In some embodiments, an APOC3 RNAi agent sense strand includes the sequence of any of the sequences in Tables 2 or 5. In some embodiments, an APOC3 RNAi agent sense strand includes the sequence of nucleotides (from 5' end→3' end) 1-18, 1-19, 1-20, 1-21, 1-22, 1-23, 1-24, 1-25, 1-26, 2-19, 2-20, 2-21, 2-22, 2-23, 2-24, 3-20, 3-21, 3-22, 3-23, 3-24, 4-21, 4-22, 4-23, 4-24, 5-22, 5-23, or 5-24 of any of the sequences in Tables 2 or 5. In certain embodiments, an APOC3 RNAi agent sense strand comprises or consists of a modified sequence of any one of the modified sequences in Table 5.

In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a "blunt end" refers to an end of a double stranded RNAi agent in which the terminal nucleotides of the two annealed strands are complementary (form a complementary base-pair).

In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands from a pair (i.e., do not form an overhang) but are not complementary (i.e. form a non-complementary pair). In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

Modified nucleotides, when used in various polynucleotide or oligonucleotide constructs, can preserve activity of the compound in cells while at the same time increasing the serum stability of these compounds, and can also minimize the possibility of activating interferon activity in humans upon administering of the polynucleotide or oligonucleotide construct.

In some embodiments, an APOC3 RNAi agent is prepared or provided as a salt, mixed salt, or a free-acid. In some embodiments, an APOC3 RNAi agent is prepared as a sodium salt. Such forms that are well known in the art are within the scope of the inventions disclosed herein.

Modified Nucleotides

In some embodiments, an APOC3 RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides (represented herein as Ab), 2'-modified nucleotides, 3' to 3' linkages (inverted) nucleotides (represented herein as invdN, invN, invn), modified nucleobase-comprising nucleotides, bridged nucleotides, peptide nucleic acids (PNAs), 2',3'-seco nucleotide mimics (unlocked nucleobase analogues, represented herein as $N_{UNA}$ or NUNA), locked nucleotides (represented herein as $N_{LNA}$ or NLNA), 3-O-methoxy (2' internucleoside linked) nucleotides (represented herein as 3'-OMen), 2'-F-Arabino nucleotides (represented herein as NfANA or $Nf_{ANA}$), 5'-Me, 2'-fluoro nucleotide (represented herein as 5Me-Nf), morpholino nucleotides, vinyl phosphonate deoxyribonucleotides (represented herein as vpdN), vinyl phosphonate containing nucleotides, and cyclopropyl phosphonate containing nucleotides (cPrpN). 2'-modified nucleotides (i.e., a nucleotide with a group other than a hydroxyl group at the 2' position of the five-membered sugar ring) include, but are not limited to, 2'-O-methyl nucleotides (represented herein as a lower case letter 'n' in a nucleotide sequence), 2'-deoxy-2'-fluoro nucleotides (also referred to herein as 2'-fluoro nucleotide, and represented herein as NO, 2'-deoxy nucleotides (represented herein as dN), 2'-methoxyethyl (2'-O-2-methoxylethyl) nucleotides (also referred to herein as 2'-MOE, and represented herein as NM), 2'-amino nucleotides, and 2'-alkyl nucleotides. It is not necessary for all positions in a given compound to be uniformly modified. Conversely, more than one modification can be incorporated in a single APOC3 RNAi agent or even in a single nucleotide thereof. The APOC3 RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and O-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense sense strand wherein substantially all of the nucleotides present are modified nucleotides is an antisense strand having two or fewer (i.e., 0, 1, or 2) nucleotides in the sense strand being unmodified ribonucleotides. In some embodiments, one or more nucleotides of an RNAi agent is an unmodified ribonucleotide.

Modified Internucleoside Linkages

In some embodiments, one or more nucleotides of an APOC3 RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and CH$_2$ components.

In some embodiments, a sense strand of an APOC3 RNAi agent can contain 1, 2, 3, 4, 5, or 6 phosphorothioate linkages, an antisense strand of an APOC3 RNAi agent can contain 1, 2, 3, 4, 5, or 6 phosphorothioate linkages, or both the sense strand and the antisense strand independently can contain 1, 2, 3, 4, 5, or 6 phosphorothioate linkages. In some embodiments, a sense strand of an APOC3 RNAi agent can contain 1, 2, 3, or 4 phosphorothioate linkages, an antisense strand of an APOC3 RNAi agent can contain 1, 2, 3, or 4 phosphorothioate linkages, or both the sense strand and the antisense strand independently can contain 1, 2, 3, or 4 phosphorothioate linkages.

In some embodiments, an APOC3 RNAi agent sense strand contains at least two phosphorothioate internucleoside linkages. In some embodiments, the at least two phosphorothioate internucleoside linkages are between the nucleotides at positions 1-3 from the 3' end of the sense strand. In some embodiments, one phosphorothioate internucleoside linkage is at the 5' end of the sense strand, and another phosphorothioate linkage is at the 3' end of the sense strand. In some embodiments, two phosphorothioate internucleoside linkage are located at the 5' end of the sense strand, and another phosphorothioate linkage is at the 3' end of the sense strand. In some embodiments, the sense strand dose not include any phosphorothioate internucleoside linkages between the nucleotides, but contains one, two, or three phosphorothioate linkages between the terminal nucleotides on both the 5' and 3' ends and the optionally present inverted abasic residue terminal caps. In some embodiments, the targeting ligand is linked to the sense strand via a phosphorothioate linkage.

In some embodiments, an APOC3 RNAi agent antisense strand contains four phosphorothioate internucleoside linkages. In some embodiments, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate internucleoside linkages are located between positions 1-4 from the 5' end of the antisense strand, and a fourth phosphorothioate internucleoside linkage is located between positions 20-21 from the 5' end of the antisense strand. In some embodiments, an APOC3 RNAi agent contains at least three or four phosphorothioate internucleoside linkages in the antisense strand.

In some embodiments, an APOC3 RNAi agent contains one or more modified nucleotides and one or more modified internucleoside linkages. In some embodiments, a 2'-modified nucleoside is combined with modified internucleoside linkage.

APOC3 RNAi Agents

In some embodiments, the APOC3 RNAi agents disclosed herein target an APOC3 gene at or near the positions of the APOC3 gene show in Table 1. In some embodiments, the antisense strand of an APOC3 RNAi agent disclosed herein includes a core stretch sequence that is fully, substantially, or at least partially complementary to a target APOC3 19-mer sequence disclosed in Table 1.

TABLE 1

APOC3 19-mer mRNA target sequences (taken from homo sapiens apolipoprotein C3 (APOC3) transcript, GenBank NM_000040.1 (SEQ ID NO: 1)).

| SEQ ID No. | APOC3 19-mer Target Sequences (5'→3') | Corresponding Positions on SEQ ID NO: 1 |
|---|---|---|
| 32 | GGGACAGUAUUCUCAGUGC | 438-456 |
| 33 | CAAUAAAGCUGGACAAGAA | 506-524 |
| 34 | UUAAAAGGGACAGUAUUCU | 432-450 |
| 35 | CGGGUACUCCUUGUUGUUG | 56-74 |
| 36 | GGUACUCCUUGUUGUUGCC | 58-76 |
| 37 | GCUGGGUGACCGAUGGCUU | 228-246 |
| 38 | GACCGAUGGCUUCAGUUCC | 235-253 |
| 39 | GCUUCAGUUCCCUGAAAGA | 243-261 |
| 40 | UCAGUUCCCUGAAAGACUA | 246-264 |
| 41 | GACUACUGGAGCACCGUUA | 260-278 |
| 42 | ACUACUGGAGCACCGUUAA | 261-279 |
| 43 | GCACCGUUAAGGACAAGUU | 270-288 |
| 44 | ACCGUUAAGGACAAGUUCU | 272-290 |
| 45 | CCGUUAAGGACAAGUUCUC | 273-291 |
| 46 | CCUCAAUACCCCAAGUCCA | 349-367 |

TABLE 1-continued

APOC3 19-mer mRNA target sequences (taken from homo sapiens apolipoprotein C3 (APOC3) transcript, GenBank NM_000040.1 (SEQ ID NO: 1)).

| SEQ ID No. | APOC3 19-mer Target Sequences (5'→3') | Corresponding Positions on SEQ ID NO: 1 |
|---|---|---|
| 47 | AAAAGGGACAGUAUUCUCA | 434-452 |
| 48 | AGGGACAGUAUUCUCAGUG | 437-455 |

In some embodiments, an APOC3 RNAi agent includes an antisense strand wherein position 19 of the antisense strand (5'→3') is capable of forming a base pair with position 1 of a 19-mer target sequence disclosed in Table 1. In some embodiments, an APOC3 RNAi agent includes an antisense strand wherein position 1 of the antisense strand (5'→3') is capable of forming a base pair with position 19 of the 19-mer target sequence disclosed in Table 1.

In some embodiments, an APOC3 RNAi agent includes an antisense strand wherein position 2 of the antisense strand (5'→3') is capable of forming a base pair with position 18 of the 19-mer target sequence disclosed in Table 1. In some embodiments, an APOC3 RNAi agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to the APOC3 gene, or can be non-complementary to the APOC3 gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, an APOC3 RNAi agent antisense strand comprises the sequence of nucleotides (from 5' end→3' end) 2-18 or 2-19 of any of the antisense strand sequences in Table 2, Table 3, or Table 4. In some embodiments, an APOC3 RNAi sense strand comprises the sequence of nucleotides (from 5' end→3' end) 1-17, 1-18, or 2-18 of any of the sense strand sequences in Table 2, Table 3, or Table 5.

In some embodiments, an APOC3 RNAi agent is comprised of (i) an antisense strand comprising the sequence of nucleotides (from 5' end→3' end) 2-18 or 2-19 of any of the antisense strand sequences in Table 2, Table 3, or Table 4, and (ii) a sense strand comprising the sequence of nucleotides (from 5' end→3' end) 1-17 or 1-18 of any of the sense strand sequences in Table 2, Table 3, or Table 5.

In some embodiments, the APOC3 RNAi agents include core 19-mer nucleotide sequences shown in the following Table 2.

TABLE 2

APOC3 RNAi Agent Antisense Strand and Sense Strand Core Stretch Base Sequences (N = any nucleobase).

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions on SEQ ID NO: 1 |
|---|---|---|---|---|
| 49 | UCACUGAGAAUACUGUCCC | 114 | GGGACAGUAUUCUCAGUGA | 438-456 |
| 49 | UCACUGAGAAUACUGUCCC | 115 | GGGACAGUAUUCUCAGUIA | 438-456 |
| 50 | GCACUGAGAAUACUGUCCC | 116 | GGGACAGUAUUCUCAGUGC | 438-456 |
| 51 | NCACUGAGAAUACUGUCCC | 117 | GGGACAGUAUUCUCAGUGN | 438-456 |
| 52 | NCACUGAGAAUACUGUCCN | 118 | NGGACAGUAUUCUCAGUGN | 438-456 |
| 53 | UUCUUGUCCAGCUUUAUUG | 119 | CAAUAAAGCUGGACAAGAA | 506-524 |
| 53 | UUCUUGUCCAGCUUUAUUG | 120 | CAAUAAAICUGGACAAGAA | 506-524 |
| 54 | NUCUUGUCCAGCUUUAUUG | 121 | CAAUAAAGCUGGACAAGAN | 506-524 |
| 55 | NUCUUGUCCAGCUUUAUUN | 122 | NAAUAAAGCUGGACAAGAN | 506-524 |
| 56 | UGAAUACUGUCCCUUUUAA | 123 | UUAAAAGGGACAGUAUUCA | 432-450 |
| 57 | AGAAUACUGUCCCUUUUAA | 124 | UUAAAAGGGACAGUAUUCU | 432-450 |
| 58 | AGAAUACUGUCCCUUUUAG | 125 | CUAAAAGGGACAGUAUUCU | 432-450 |
| 59 | NGAAUACUGUCCCUUUUAA | 126 | UUAAAAGGGACAGUAUUCN | 432-450 |
| 60 | NGAAUACUGUCCCUUUUAG | 127 | CUAAAAGGGACAGUAUUCN | 432-450 |
| 61 | NGAAUACUGUCCCUUUUAN | 128 | NUAAAAGGGACAGUAUUCN | 432-450 |
| 62 | UAACAACAAGGAGUACCCG | 129 | CGGGUACUCCUUGUUGUUA | 56-74 |
| 63 | CAACAACAAGGAGUACCCG | 130 | CGGGUACUCCUUGUUGUUG | 56-74 |
| 64 | NAACAACAAGGAGUACCCG | 131 | CGGGUACUCCUUGUUGUUN | 56-74 |

TABLE 2-continued

APOC3 RNAi Agent Antisense Strand and Sense Strand Core Stretch Base Sequences
(N = any nucleobase).

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions on SEQ ID NO: 1 |
|---|---|---|---|---|
| 65 | NAACAACAAGGAGUACCCN | 132 | NGGGUACUCCUUGUUGUUN | 56-74 |
| 66 | UGCAACAACAAGGAGUACC | 133 | GGUACUCCUUGUUGUUGCA | 58-76 |
| 67 | GGCAACAACAAGGAGUACC | 134 | GGUACUCCUUGUUGUUGCC | 58-76 |
| 68 | NGCAACAACAAGGAGUACC | 135 | GGUACUCCUUGUUGUUGCN | 58-76 |
| 69 | NGCAACAACAAGGAGUACN | 136 | NGUACUCCUUGUUGUUGCN | 58-76 |
| 70 | UAGCCAUCGGUCACCCAGC | 137 | GCUGGGUGACCGAUGGCUA | 228-246 |
| 71 | AAGCCAUCGGUCACCCAGC | 138 | GCUGGGUGACCGAUGGCUU | 228-246 |
| 72 | NAGCCAUCGGUCACCCAGC | 139 | GCUGGGUGACCGAUGGCUN | 228-246 |
| 73 | NAGCCAUCGGUCACCCAGN | 140 | NCUGGGUGACCGAUGGCUN | 228-246 |
| 74 | UGAACUGAAGCCAUCGGUC | 141 | GACCGAUGGCUUCAGUUCA | 235-253 |
| 75 | GGAACUGAAGCCAUCGGUC | 142 | GACCGAUGGCUUCAGUUCC | 235-253 |
| 76 | NGAACUGAAGCCAUCGGUC | 143 | GACCGAUGGCUUCAGUUCN | 235-253 |
| 77 | NGAACUGAAGCCAUCGGUN | 144 | NACCGAUGGCUUCAGUUCN | 235-253 |
| 78 | UCUUUCAGGGAACUGAAGC | 145 | GCUUCAGUUCCCUGAAAGA | 243-261 |
| 79 | NCUUUCAGGGAACUGAAGC | 146 | GCUUCAGUUCCCUGAAAGN | 243-261 |
| 80 | NCUUUCAGGGAACUGAAGN | 147 | NCUUCAGUUCCCUGAAAGN | 243-261 |
| 81 | UAGUCUUUCAGGGAACUGA | 148 | UCAGUUCCCUGAAAGACUA | 246-264 |
| 82 | NAGUCUUUCAGGGAACUGA | 149 | UCAGUUCCCUGAAAGACUN | 246-264 |
| 83 | NAGUCUUUCAGGGAACUGN | 150 | NCAGUUCCCUGAAAGACUN | 246-264 |
| 84 | UAACGGUGCUCCAGUAGUC | 151 | GACUACUGGAGCACCGUUA | 260-278 |
| 85 | NAACGGUGCUCCAGUAGUC | 152 | GACUACUGGAGCACCGUUN | 260-278 |
| 86 | NAACGGUGCUCCAGUAGUN | 153 | NACUACUGGAGCACCGUUN | 260-278 |
| 87 | UUAACGGUGCUCCAGUAGU | 154 | ACUACUGGAGCACCGUUAA | 261-279 |
| 88 | NUAACGGUGCUCCAGUAGU | 155 | ACUACUGGAGCACCGUUAN | 261-279 |
| 89 | NUAACGGUGCUCCAGUAGN | 156 | NCUACUGGAGCACCGUUAN | 261-279 |
| 90 | UACUUGUCCUUAACGGUGC | 157 | GCACCGUUAAGGACAAGUA | 270-288 |
| 91 | AACUUGUCCUUAACGGUGC | 158 | GCACCGUUAAGGACAAGUU | 270-288 |
| 92 | NACUUGUCCUUAACGGUGC | 159 | GCACCGUUAAGGACAAGUN | 270-288 |
| 93 | NACUUGUCCUUAACGGUGN | 160 | NCACCGUUAAGGACAAGUN | 270-288 |
| 94 | UGAACUUGUCCUUAACGGU | 161 | ACCGUUAAGGACAAGUUCA | 272-290 |
| 95 | AGAACUUGUCCUUAACGGU | 162 | ACCGUUAAGGACAAGUUCU | 272-290 |
| 96 | NGAACUUGUCCUUAACGGU | 163 | ACCGUUAAGGACAAGUUCN | 272-290 |
| 97 | NGAACUUGUCCUUAACGGN | 164 | NCCGUUAAGGACAAGUUCN | 272-290 |
| 98 | UAGAACUUGUCCUUAACGG | 165 | CCGUUAAGGACAAGUUCUA | 273-291 |
| 99 | GAGAACUUGUCCUUAACGG | 166 | CCGUUAAGGACAAGUUCUC | 273-291 |
| 100 | NAGAACUUGUCCUUAACGG | 167 | CCGUUAAGGACAAGUUCUN | 273-291 |

TABLE 2-continued

APOC3 RNAi Agent Antisense Strand and Sense Strand Core Stretch Base Sequences
(N = any nucleobase).

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions on SEQ ID NO: 1 |
|---|---|---|---|---|
| 101 | NAGAACUUGUCCUUAACGN | 168 | NCGUUAAGGACAAGUUCUN | 273-291 |
| 102 | UGGACUUGGGGUAUUGAGG | 169 | CCUCAAUACCCCAAGUCCA | 349-367 |
| 103 | NGGACUUGGGGUAUUGAGG | 170 | CCUCAAUACCCCAAGUCCN | 349-367 |
| 104 | NGGACUUGGGGUAUUGAGN | 171 | NCUCAAUACCCCAAGUCCN | 349-367 |
| 105 | UGAGAAUACUGUCCCUUUU | 172 | AAAAGGGACAGUAUUCUCA | 434-452 |
| 106 | UGAGAAUACUGUCCCUUUG | 173 | CAAAGGGACAGUAUUCUCA | 434-452 |
| 107 | NGAGAAUACUGUCCCUUUU | 174 | AAAAGGGACAGUAUUCUCN | 434-452 |
| 108 | NGAGAAUACUGUCCCUUUG | 175 | CAAAGGGACAGUAUUCUCN | 434-452 |
| 109 | NGAGAAUACUGUCCCUUUN | 176 | NAAAGGGACAGUAUUCUCN | 434-452 |
| 110 | UACUGAGAAUACUGUCCCU | 177 | AGGGACAGUAUUCUCAGUA | 437-455 |
| 111 | CACUGAGAAUACUGUCCCU | 178 | AGGGACAGUAUUCUCAGUG | 437-455 |
| 112 | NACUGAGAAUACUGUCCCU | 179 | AGGGACAGUAUUCUCAGUN | 437-455 |
| 113 | NACUGAGAAUACUGUCCCN | 180 | NGGGACAGUAUUCUCAGUN | 437-455 |

The APOC3 RNAi agent sense strands and antisense strands that comprise or consist of the nucleotide sequences in Table 2 can be modified nucleotides or unmodified nucleotides. In some embodiments, the APOC3 RNAi agents having the sense and antisense strand sequences that comprise or consist of the nucleotide sequences in Table 2 are all or substantially all modified nucleotides.

In some embodiments, the antisense strand of an APOC3 RNAi agent disclosed herein differs by 0, 1, 2, or 3 nucleotides from any of the antisense strand sequences in Table 2. In some embodiments, the sense strand of an APOC3 RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified APOC3 RNAi agent antisense strands, as well as their underlying unmodified nucleobase sequences, are provided in Tables 3 and 4. Certain modified APOC3 RNAi agent sense strands, as well as their underlying unmodified nucleobase sequences, are provided in Tables 3 and 5. In forming APOC3 RNAi agents, each of the nucleotides in each of the underlying base sequences listed in Tables 3, 4, and 5, as well as in Table 2, above, can be a modified nucleotide.

The APOC3 RNAi agents described herein are formed by annealing an antisense strand with a sense strand. A sense strand containing a sequence listed in Table 2, Table 3, or Table 5, can be hybridized to any antisense strand containing a sequence listed in Table 2, Table 3, or Table 4, provided the two sequences have a region of at least 85% complementarily over a contiguous 16, 17, 18, 19, 20, or 21 nucleotide sequence.

In some embodiments, an APOC3 RNAi agent antisense strand comprises a nucleotide sequence of any of the sequences in Table 2, Table 3, or Table 4.

In some embodiments, an APOC3 RNAi agent comprises or consists of a duplex having the nucleobase sequences of the sense strand and the antisense strand of any of the sequences in Table 2, Table 3, Table 4, or Table 5.

Examples of antisense strands containing modified nucleotides are provided in Table 4. Examples of sense strands containing modified nucleotides are provided in Table 5. Further examples of antisense strands and sense strands containing modified nucleotides are provided in Table 3.

As used in Tables 3, 4. and 5, the following notations are used to indicate modified nucleotides, targeting groups, and linking groups:

A=adenosine-3'-phosphate;

C=cytidine-3'-phosphate;

G=guanosine-3'-phosphate;

U=uridine-3'-phosphate

I=inosine-3'-phosphate
n=any 2'-OMe modified nucleotide
a=2'-O-methyladenosine-3'-phosphate
as=2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate
gs=2'-O-methylguanosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
i=2'-O-methylinosine-3'-phosphate
is=2'-O-methylinosine-3'-phosphorothioate
Nf=any 2'-fluoro modified nucleotide
Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
If=2'-fluoroinosine-3'-phosphate
Ifs=2'-fluoroinosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dN=any 2'-deoxyribonucleotide
dA=2'-deoxyadenosine-3'-phosphate
dAs=2'-deoxyadenosine-3'-phosphorothioate
dC=2'-deoxycytidine-3'-phosphate
dCs=2'-deoxycytidine-3'-phosphorothioate
dG=2'-deoxyguanosine-3'-phosphate
dGs=2'-deoxyguanosine-3'-phosphorothioate
dT=2'-deoxythymidine-3'-phosphate
dTs=2'-deoxythymidine-3'-phosphorothioate
dU=2'-deoxyuridine-3'-phosphate
dUs=2'-deoxyuridine-3'-phosphorothioate
$N_{UNA}$=2',3'-seco nucleotide mimics (unlocked nucleobase analogs)-3'-Phosphate
$N_{UNAS}$=2',3'-seco nucleotide mimics (unlocked nucleobase analogs)-3'-phosphorothioate
$A_{UNA}$=2',3'-seco-adenosine-3'-phosphate
$A_{UNAS}$=2',3'-seco-adenosine-3'-phosphorothioate
$C_{UNA}$=2',3'-seco-cytidine-3'-phosphate
$C_{UNAS}$=2',3'-seco-cytidine-3'-phosphorothioate
$G_{UNA}$=2',3'-seco-guanosine-3'-phosphate
$G_{UNAS}$=2',3'-seco-guanosine-3'-phosphorothioate
$U_{UNA}$=2',3'-seco-uridine-3'-phosphate
$U_{UNAS}$=2',3'-seco-uridine-3'-phosphorothioate
a_2N=see Table 7
a_2Ns=see Table 7
pu_2N=see Table 7
pu_2Ns=see Table 7
$N_{LNA}$=locked nucleotide
$Nf_{ANA}$=2'-F-Arabino nucleotide
NM=2'-O-methoxyethyl nucleotide
AM=2'-O-methoxyethyladenosine-3'-phosphate
AMs=2'-O-methoxyethyladenosine-3'-phosphorothioate
GM=2'-O-methoxyethylguanosine-3'-phosphate
GMs=2'-O-methoxyethylguanosine-3'-phosphorothioate
TM=2'-O-methoxyethylthymidine-3'-phosphate
TMs=2'-O-methoxyethylthymidine-3'-phosphorothioate
mCM=see Table 7
mCMs=see Table 7
R=ribitol
(invdN)=any inverted deoxyribonucleotide (3'-3' linked nucleotide)
(invAb)=inverted (3'-3' linked) abasic deoxyribonucleotide, see Table 7
(invAb)s=inverted (3'-3' linked) abasic deoxyribonucleotide-5'-phosphorothioate, see Table 7
(invn)=any inverted 2'-OMe nucleotide (3'-3' linked nucleotide)
s=phosphorothioate linkage
sp=see Table 7
D2u=see Table 7
pD2u=see Table 7
vpdN=vinyl phosphonate deoxyribonucleotide
(5Me-Nf)=5'-Me, 2'-fluoro nucleotide
cPrp=cyclopropyl phosphonate, see Table 7
epTcPr=see Table 7
epTM=see Table 7

As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate linkage as shown in the modified nucleotide sequences disclosed herein replaces the phosphodiester linkage typically present in oligonucleotides (see, e.g., FIGS. 1A through 1I showing all internucleoside linkages). Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Moreover, as the person of ordinary skill would readily understand and appreciate, while the phosphorothioate chemical structures depicted herein typically show the anion on the sulfur atom, the inventions disclosed herein encompass all phosphorothioate tautomers and/or diastereomers (e.g., where the sulfur atom has a double-bond and the anion is on an oxygen atom). Unless expressly indicated otherwise herein, such understandings of the person of ordinary skill in the art are used when describing the APOC3 RNAi agents and compositions of APOC3 RNAi agents disclosed herein.

Certain examples of targeting groups and linking groups used with the APOC3 RNAi agents disclosed herein are provided below in Table 7. More specifically, targeting groups and linking groups include the following, for which their chemical structures are provided below in Table 7: (PAZ), (NAG13), (NAG13)s, (NAG18), (NAG18)s, (NAG24), (NAG24)s, (NAG25), (NAG25)s, (NAG26), (NAG26)s, (NAG27), (NAG27)s, (NAG28), (NAG28)s, (NAG29), (NAG29)s, (NAG30), (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), (NAG39)s. Each sense strand and/or antisense strand can have any targeting groups or linking groups listed herein, as well as other targeting or linking groups, conjugated to the 5' and/or 3' end of the sequence.

TABLE 3

APOC3 RNAi Agent Modified Antisense Strand and Modified Sense Strand Duplexes

| DUPLEX ID NO.: | SEQ ID NO. | Antisense Sequence (5'→3') | SEQ ID NO. | Sense Sequence (5'→3') |
|---|---|---|---|---|
| 56_1 | 181 | uAfaCfaAfcAfAfGfgAfgUfaCfcCfguu | 246 | cgGfgUfaCfUfCfcUfuGfuUfgUfuauu |
| 56_2 | 182 | uAfaCfaAfcAfaGfgAfgUfaCfcCfguu | 247 | cggguaCfUfCfcuuguuguuauu |
| 56_3 | 183 | uAfaCfaAfcAfaGfgAfgUfaCfcCfggu | 248 | ccgggtuaCfUfCfcuuguuguua |
| 56_4 | 184 | uAfaCfaAfcAfaGfgAfgUfaCfcCfggg | 249 | cccgggtuaCfUfCfcuuguuguua |
| 56_5 | 185 | uAfaCfaAfcaaggAfgUfaCfcCfggg | 250 | cccgggtuaCfUfCfcuuguuguua |
| 58_1 | 186 | uGfcAfaCfaAfCfAfaGfaGfUfaCfcuu | 251 | ggUfaCfuCfCfUfuGfuUfgUfuGfcauu |
| 58_2 | 187 | uGfcAfaCfaAfcAfaGfaGfUfaCfcuu | 252 | gguacuCfCfUfuguuguugcauu |
| 58_3 | 188 | uGfcAfaCfaAfcAfaGfaGfUfaCfccu | 253 | ggguacuCfCfUfuguuguugca |
| 58_4 | 189 | uGfcAfaCfaAfcAfaGfaGfUfaCfccg | 254 | cgggtacuCfCfUfuguuguugca |
| 58_5 | 190 | uGfcAfaCfaacaaGfaGfUfaCfccg | 255 | cgggtacuCfCfUfuguuguugca |
| 228_1 | 191 | uAfgCfcAfuCfGfGffuCfaCfcCfaGfcuu | 256 | gcUfgGfgUfGfAfcCfgAfuGfgCfuauu |
| 228_2 | 192 | uAfgCfcAfuCfgGfuCfaCfcCfaGfcuu | 257 | gcugggUfGfAfccgauggcuauu |
| 228_3 | 193 | uAfgCfcAfuCfgGfuCfaCfcCfaGfccu | 258 | ggcugggUfGfAfccgauggcua |
| 228_4 | 194 | uAfgCfcAfuCfgGfuCfaCfcCfaGfccc | 259 | gggcugggUfGfAfccgauggcua |
| 228_5 | 195 | uAfgCfcAfucgguCfaCfcCfaGfccc | 260 | gggcugggUfGfAfccgauggcua |
| 235_1 | 196 | uGfaAfcUfgAfAfGfcCfaUfcGfgUfcuu | 261 | gaCfcGfaUfGfGfcUfuCfaGfuticauu |
| 235_2 | 197 | uGfaAfcUfgAfaGfcCfaUfcGfgUfcuu | 262 | gaccgaUfGfGfcuucaguucauu |
| 235_3 | 198 | uGfaAfcUfgAfaGfcCfaUfcGfgUfcau | 263 | ugaccgaUfGfGfcuucaguuca |
| 235_4 | 199 | uGfaAfcUfgAfaGfcCfaUfcGfgUfcac | 264 | gugaccgaUfGfGfcuucaguuca |
| 235_5 | 200 | uGfaAfcUfgaagcCfaUfcGfgUfcac | 265 | gugaccgaUfGfGfcuucaguuca |
| 243_1 | 201 | uCfuUffuCfaGfgGfaAfcUfgAfaGfcuu | 266 | gcUfuCfaGfUfUfcCfcUfgAfaAfgauu |
| 243_2 | 202 | uCfuUffuCfaGfgGfaAfcUfgAfaGfcuu | 267 | gcuucaGfUfUfcccugaaagauu |
| 243_3 | 203 | uCfuUffuCfaGfgGfaAfcUfgAfaGfccu | 268 | ggcuucaGfUfUfcccugaaaga |
| 243_4 | 204 | uCfuUffuCfaGfgGfaAfcUfgAfaGfcca | 269 | uggcuucaGfUfUfcccugaaaga |
| 243_5 | 205 | uCfuUfuCfagggaAfcUfgAfaGfcca | 270 | uggcuucaGfUfUfcccugaaaga |
| 260_1 | 206 | uAfaCfgGfuGfCfUfcCfaGfuAfgUfcuu | 271 | gaCfuAfcUfGfGfaGfcAfcCfgUfuauu |
| 260_2 | 207 | uAfaCfgGfuGfcUfcCfaGfuAfgUfcuu | 272 | gacuacUfGfGfagcaccguuauu |
| 260_3 | 208 | uAfaCfgGfuGfcUfcCfaGfuAfgUfcuu | 273 | agacuacUfGfGfagcaccguua |
| 260_4 | 209 | uAfaCfgGfuGfcUfcCfaGfuAfgUfcuu | 274 | aagacuacUfGfGfagcaccguua |
| 260_5 | 210 | uAfaCfgGfugcucCfaGfuAfgUfcuu | 275 | aagacuacUfGfGfagcaccguua |
| 261_1 | 211 | uUfaAfcGfgUfGfCfuCfcAfgUfaGfuuu | 276 | acUfaCfuGfGfAfgCfaCfcGfuUfaauu |
| 261_2 | 212 | uUfaAfcGfgUfgCfuCfcAfgUfaGfuuu | 277 | acuacuGfGfAfgcaccguuaauu |
| 261_3 | 213 | uUfaAfcGfgUfgCfuCfcAfgUfaGfucu | 278 | gacuacuGfGfAfgcaccguuaa |
| 261_4 | 214 | uUfaAfcGfgUfgCfuCfcAfgUfaGfucu | 279 | agacuacuGfGfAfgcaccguuaa |
| 261_5 | 215 | uUfaAfcGfgugcuCfcAfgUfaGfucu | 280 | agacuacuGfGfAfgcaccguuaa |
| 270_1 | 216 | uAfcUfuGfuCffCffuAfcCfgGfuGfcuu | 281 | gcAfcCfgUfUfAfaGfgAfcAfaGfuauu |
| 270_2 | 217 | uAfcUfuGfuCfcUfuAfaCfgGfuGfcuu | 282 | gcaccgUfUfAfaggacaaguauu |
| 270_3 | 218 | uAfcUfuGfuCfcUfuAfaCfgGfuGfcuu | 283 | agcaccgUfUfAfaggacaagua |

TABLE 3-continued

APOC3 RNAi Agent Modified Antisense Strand and Modified Sense Strand Duplexes

| DUPLEX ID NO.: | SEQ ID NO. | Antisense Sequence (5'→3') | SEQ ID NO. | Sense Sequence (5'→3') |
|---|---|---|---|---|
| 270_4 | 219 | uAfcUfuGfuCfcUfuAfaCfgGfuGfcuc | 284 | gagcaccgUfUfAfaggacaagua |
| 270_5 | 220 | uAfcUfuGfuccuuAfaCfgGfuGfcuc | 285 | gagcaccgUfUfAfaggacaagua |
| 272_1 | 221 | uGfaAfcUfuGfUfCfcUfuAfaCfgGfuuu | 286 | acCfgUfuAfAfGfgAfcAfaGfuUfcauu |
| 272_2 | 222 | uGfaAfcUfuGfuCfcUfuAfaCfgGfuuu | 287 | accguuAfAfGfgacaaguucauu |
| 272_3 | 223 | uGfaAfcUfuGfuCfcUfuAfaCfgGfugu | 288 | caccguuAfAfGfgacaaguuca |
| 272_4 | 224 | uGfaAfcUfuGfuCfcUfuAfaCfgGfugc | 289 | gcaccguuAfAfGfgacaaguuca |
| 272_5 | 225 | uGfaAfcUfuguccUfuAfaCfgGfugc | 290 | gcaccguuAfAfGfgacaaguuca |
| 273_1 | 226 | uAfgAfaCfuUfGfUfcCfuUfaAfcGfguu | 291 | ccGfuUfaAfgGfgfaCfaAfgUfuCfuauu |
| 273_2 | 227 | uAfgAfaCfuUfgUfcCfuUfaAfcGfguu | 292 | ccguuaAfGfGfacaaguucuauu |
| 273_3 | 228 | uAfgAfaCfuUfgUfcCfuUfaAfcGfguu | 293 | accguuaAfGfGfacaaguucua |
| 273_4 | 229 | uAfgAfaCfuUfgUfcCfuUfaAfcGfgug | 294 | caccguuaAfGfGfacaaguucua |
| 273_5 | 230 | uAfgAfaCfuugucCfuUfaAfcGfgug | 295 | caccguuaAfGfGfacaaguucua |
| 349_1 | 231 | uGfgAfcUfuGfGfGfgUfaUfuGfaGfguu | 296 | ccUfcAfaUfAfCfcCfcAfaGfuCfcauu |
| 349_2 | 232 | uGfgAfcUfuGfgGfgUfaUfuGfaGfguu | 297 | ccucaaUfAfCfcccaaguccauu |
| 349_3 | 233 | uGfgAfcUfuGfgGfgUfaUfuGfaGfguu | 298 | accucaaUfAfCfcccaagucca |
| 349_4 | 234 | uGfgAfcUfuGfgGfgUfaUfuGfaGfguc | 299 | gaccucaaUfAfCfcccaagucca |
| 349_5 | 235 | uGfgAfcUfugggGfuaUfuGfaGfguc | 300 | gaccucaaUfAfCfcccaagucca |
| 434_1 | 236 | uGfaGfaAfuAfCfUfgUfcCfcUfuUfuuu | 301 | aaAfaGfgGfAfCfaGfuAfuUfcUfcauu |
| 434_2 | 237 | uGfaGfaAfuAfcUfgUfcCfcUfuUfuuu | 302 | aaaaggGfAfCfaguauucucauu |
| 434_3 | 238 | uGfaGfaAfuAfcUfgUfcCfcUfuUfuau | 303 | uaaaaggGfAfCfaguauucuca |
| 434_4 | 239 | uGfaGfaAfuAfcUfgUfcCfcUfuUfuaa | 304 | uuaaaaggGfAfCfaguauucuca |
| 434_5 | 240 | uGfaGfaAfuacugUfcCfcUfuUfuaa | 305 | uuaaaaggGfAfCfaguauucuca |
| 437_1 | 241 | uAfcUfgAfgAfAfUfaCfuGfuCfcCfuuu | 306 | agGfgAfcAfGfUfaUfuCfuCfaGfuauu |
| 437_2 | 242 | uAfcUfgAfgAfaUfaCfuGfuCfcCfuuu | 307 | agggacAfGfUfauucucaguauu |
| 437_3 | 243 | uAfcUfgAfgAfaUfaCfuGfuCfcCfuuu | 308 | aagggacAfGfUfauucucagua |
| 437_4 | 244 | uAfcUfgAfgAfaUfaCfuGfuCfcCfuuu | 309 | aaagggacAfGfUfauucucagua |
| 437_5 | 245 | uAfcUfgAfgaauaCfuGfuCfcCfuuu | 310 | aaagggacAfGfUfauucucagua |

TABLE 4

APOC3 RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM06203-AS | usAfscsUfuGfuCfcUfuAfaCfgGfuGfcusu | 311 | UACUUGUCCUUAACGGUGCUU | 603 |
| AM06204-AS | usAfscsUfuGfuCfcUfuAfaCfgGfuGfcusc | 312 | UACUUGUCCUUAACGGUGCUC | 604 |
| AM06205-AS | asAfscsUfuGfuCfcUfuAfaCfgGfuGfcusu | 313 | AACUUGUCCUUAACGGUGCUU | 655 |
| AM06210-AS | usGfsgsAfcUfuGfgGfgUfaUfuGfaGfgusu | 314 | UGGACUUGGGGUAUUGAGGUU | 610 |

TABLE 4-continued

APOC3 RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
| --- | --- | --- | --- | --- |
| AM06211-AS | usGfsgsAfcUfuGfgGfgUfaUfuGfaGfgusc | 315 | UGGACUGGGGUAUUGAGGUC | 611 |
| AM06214-AS | usCfsusUfuCfaGfgGfaAfcUfgAfaGfcusu | 316 | UCUUUCAGGGAACUGAAGCUU | 597 |
| AM06215-AS | usCfsusUfuCfaGfgGfaAfcUfgAfaGfccsu | 317 | UCUUUCAGGGAACUGAAGCCU | 598 |
| AM06218-AS | usGfsasAfcUfgAfaGfcCfaUfcGfgUfcusu | 318 | UGAACUGAAGCCAUCGGUCUU | 594 |
| AM06219-AS | usGfsasAfcUfgAfaGfcCfaUfcGfgUfcasc | 319 | UGAACUGAAGCCAUCGGUCAC | 596 |
| AM06262-AS | usGfsasGfaAfuAfcUfgUfcCfcUfuUfugsg | 320 | UGAGAAUACUGUCCCUUUUGG | 656 |
| AM06263-AS | usGfsasGfaAfuAfcUfgUfcCfcUfuUfugcsg | 321 | UGAGAAUACUGUCCCUUUUGCG | 657 |
| AM06266-AS | usAfsasCfgGfuGfcUfcCfaGfuAfgUfcusu | 322 | UAACGGUGCUCCAGUAGUCUU | 500 |
| AM06267-AS | usAfsasCfgGfuGfcUfcCfaGfuAfgUfcgsu | 323 | UAACGGUGCUCCAGUAGUCGU | 658 |
| AM06272-AS | usAfscsUfgAfgAfaUfaCfuGfuCfcCfuusu | 324 | UACUGAGAAUACUGUCCCUUU | 615 |
| AM06273-AS | usAfscsUfgAfgAfaUfaCfuGfuCfcCfugsu | 325 | UACUGAGAAUACUGUCCCUGU | 659 |
| AM06276-AS | usUfsasAfcGfgUfgCfuCfcAfgUfaGfucsu | 326 | UUAACGGUGCUCCAGUAGUCU | 602 |
| AM06277-AS | usUfsasAfcGfgUfgCfuCfcAfgUfaGfgcsu | 327 | UUAACGGUGCUCCAGUAGGCU | 660 |
| AM06309-AS | usAfsgsCfcAfuCfgGfuCfaCfcCfaGfcusu | 328 | UAGCCAUCGGUCACCCAGCUU | 591 |
| AM06310-AS | asAfsgsCfcAfuCfgGfuCfaCfcCfaGfcusu | 329 | AAGCCAUCGGUCACCCAGCUU | 661 |
| AM06314-AS | usAfsgsAfaCfuUfgUfcCfuUfaAfcGfgusu | 330 | UAGAACUUGUCCUUAACGGUU | 608 |
| AM06315-AS | usAfsgsAfaCfuUfgUfcCfuUfaAfcGfgusg | 331 | UAGAACUUGUCCUUAACGGUG | 609 |
| AM06318-AS | usGfsasAfcUfuGfuCfcUfuAfaCfgGfuusu | 332 | UGAACUUGUCCUUAACGGUUU | 65 |
| AM06319-AS | asGfsasAfcUfuGfuCfcUfuAfaCfgGfuusu | 333 | AGAACUUGUCCUUAACGGUUU | 662 |
| AM06320-AS | usGfsasAfcUfuGfuCfcUfuAfaCfgGfugsc | 334 | UGAACUUGUCCUUAACGGUGC | 607 |
| AM06324-AS | usGfscsAfaCfaAfcAfaGfgAfgUfaCfcusu | 335 | UGCAACAACAAGGAGUACCUU | 588 |
| AM06325-AS | usGfscsAfaCfaAfcAfaGfgAfgUfaCfccsg | 336 | UGCAACAACAAGGAGUACCCG | 590 |
| AM06328-AS | usAfsasCfaAfcAfaGfgAfgUfaCfcCfgusu | 337 | UAACAACAAGGAGUACCCGUU | 585 |
| AM06330-AS | usGfscsAfcUfgAfgAfaUfaCfuGfuCfccusu | 338 | UGCACUGAGAAUACUGUCCCUU | 663 |
| AM06331-AS | asGfscsAfcUfgAfgAfaUfaCfuGfuCfccusu | 339 | AGCACUGAGAAUACUGUCCCUU | 664 |
| AM06469-AS | cPrpusAfscsUfgGfuCfcUfuAfaCfgGfuGfcusu | 340 | UACUUGUCCUUAACGGUGCUU | 603 |
| AM06471-AS | asAfscsUfgGfuCfcUfuAfaCfgGfuGfcusc | 341 | AACUUGUCCUUAACGGUGCUC | 666 |
| AM06472-AS | usAfscsUfgGfuCfcUfuAfaCfgGfugsc | 342 | UACUUGUCCUUAACGGUGC | 667 |
| AM06475-AS | usAfscsUfgGfuCfcUfuAfaCfgGfuGfcucsc | 343 | UACUUGUCCUUAACGGUGCUCC | 668 |
| AM06476-AS | usAfscsUfgGfuCfcUfuAfaCfgGfuGfcucusu | 344 | UACUUGUCCUUAACGGUGCUCUU | 669 |
| AM06477-AS | usAfscsUfgGfuCfcUfuAfaCfgGfuGfcuccsa | 345 | UACUUGUCCUUAACGGUGCUCCA | 670 |
| AM06478-AS | asAfscsUfgGfuCfcUfuAfaCfgGfugsc | 346 | AACUUGUCCUUAACGGUGC | 671 |
| AM06481-AS | asAfscsUfgGfuCfcUfuAfaCfgGfuGfcucsc | 347 | AACUUGUCCUUAACGGUGCUCC | 672 |
| AM06507-AS | usGfsasGfaAfuAfcUfgUfcCfcUfulffuusu | 348 | UGAGAAUACUGUCCCUUUUUU | 612 |
| AM06509-AS | usGfsasGfaAfuAfcUfgUfcCfcUfulffugsu | 349 | UGAGAAUACUGUCCCUUUUGU | 673 |
| AM06511-AS | usGfsaGfaAfuAfcUfgUfcCfcUfuUfugsg | 350 | UGAGAAUACUGUCCCUUUUGG | 656 |
| AM06513-AS | asGfsasGfaAfuAfcUfgUfcCfcUfuUfugsg | 351 | AGAGAAUACUGUCCCUUUUGG | 674 |

TABLE 4-continued

APOC3 RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM06514-AS | usGfscsAfaCfaAfcAfaGfgAfgUfaCfsc | 352 | UGCAACAACAAGGAGUACC | 675 |
| AM06517-AS | usGfscsAfaCfaacaaGfgAfgUfaCfccsu | 353 | UGCAACAACAAGGAGUACCCU | 589 |
| AM06518-AS | usGfscsAfaCfaacaaGfgAfgUfaCfcusu | 354 | UGCAACAACAAGGAGUACCUU | 588 |
| AM06519-AS | usGfscsaacaAfcAfaGfgAfguaccusu | 355 | UGCAACAACAAGGAGUACCUU | 588 |
| AM06521-AS | usGfcAfaCfaAfcAfaGfgAfgUfaCfcusu | 356 | UGCAACAACAAGGAGUACCUU | 588 |
| AM06523-AS | asGfscsAfaCfaAfcAfaGfgAfgUfaCfcusu | 357 | AGCAACAACAAGGAGUACCUU | 676 |
| AM06712-AS | usCfsusGfaAfgccauCfgGfuCfaCfcCfsa | 358 | UCUGAAGCCAUCGGUCACCCA | 677 |
| AM06714-AS | asCfsusGfaAfgccauCfgGfuCfaCfcCfsa | 359 | ACUGAAGCCAUCGGUCACCCA | 678 |
| AM06716-AS | usGfsgsAfaCfugaagCfcAfuCfgGfuCfsa | 360 | UGGAACUGAAGCCAUCGGUCA | 679 |
| AM06718-AS | usGfsgsAfaCfugaagCfcAfuCfgGfuCfsc | 361 | UGGAACUGAAGCCAUCGGUCC | 680 |
| AM06720-AS | usUfscsUfuUfcagggAfaCfuGfaAfgCfsc | 362 | UUCUUUCAGGGAACUGAAGCC | 681 |
| AM06722-AS | usUfsusAfaCfggugcUfcCfaGfuAfgUfsc | 363 | UUUAACGGUGCUCCAGUAGUC | 682 |
| AM06724-AS | usCfscsUfuAfacgguGfcUfcCfaGfuAfsg | 364 | UCCUUAACGGUGCUCCAGUAG | 683 |
| AM06726-AS | usUfscsCfuUfaacggUfgCfuCfcAfgUfsa | 365 | UUCCUUAACGGUGCUCCAGUA | 684 |
| AM06728-AS | usUfscsCfuUfaacggUfgCfuCfcAfgUfsc | 366 | UUCCUUAACGGUGCUCCAGUC | 685 |
| AM06730-AS | usAfscsUfuGfuCfcUfuAfaCfgGfuGfcUfsc | 367 | UACUUGUCCUUAACGGUGCUC | 604 |
| AM06732-AS | asAfscsUfuGfuCfcUfuAfaCfgGfuGfcsUfsc | 368 | AACUUGUCCUUAACGGUGCUC | 666 |
| AM06734-AS | usUfsgsAfgGfucucaGfgCfaGfcCfaCfsu | 369 | UUGAGGUCUCAGGCAGCCACU | 686 |
| AM06736-AS | usUfsasUfuGfaGfgUfcUfcAfgGfcAfgCfsc | 370 | UUAUUGAGGUCUCAGGCAGCC | 687 |
| AM06738-AS | usGfsusAfuUfgAfgGfuCfuCfaGfgCfaGfsc | 371 | UGUAUUGAGGUCUCAGGCAGC | 688 |
| AM06740-AS | usCfsasCfuGfaGfaAfuAfcUfgUfcCfcUfsu | 372 | UCACUGAGAAUACUGUCCCUU | 689 |
| AM06741-AS | usCfsasCfuGfagaauAfcUfgUfcCfcUfsu | 373 | UCACUGAGAAUACUGUCCCUU | 689 |
| AM06743-AS | usCfsasCfuGfagaauAfcUfgUfcCfcGfsu | 4 | UCACUGAGAAUACUGUCCCGU | 5 |
| AM06745-AS | usCfsusUfuUfaAfgCfaAfcCfuAfcAfgGfsg | 374 | UCUUUUAAGCAACCUACAGGG | 690 |
| AM06780-AS | usGfsasGfaAfuAfcUfgUfcCfcUfuUfucsc | 375 | UGAGAAUACUGUCCCUUUUCC | 691 |
| AM06783-AS | usCfsasCfuGfagaauAfcUfgUfcCfcUfsc | 2 | UCACUGAGAAUACUGUCCCUC | 3 |
| AM06784-AS | usUfsasUfuGfaggucUfcAfgGfcAfgCfsc | 376 | UUAUUGAGGUCUCAGGCAGCC | 687 |
| AM06786-AS | usGfsasGfaAfuAfcUfgUfcCfcUfuUfgcsc | 13 | UGAGAAUACUGUCCCUUUGCC | 14 |
| AM06862-AS | usGfsasGfaAfuAfcUfgUfcCfcUfuUfuCfsc | 377 | UGAGAAUACUGUCCCUUUUCC | 691 |
| AM06865-AS | usGfsasGfaAfuAfcUfgUfcCfcUfuUfucsu | 378 | UGAGAAUACUGUCCCUUUUCU | 692 |
| AM06868-AS | usUfscsUfuGfuCfcAfgCfuUfuAfuUfgGfsg | 379 | UUCUUGUCCAGCUUUAUUGGG | 693 |
| AM06870-AS | usUfscsUfuGfuCfcAfgCfuUfuAfuUfgGfsc | 7 | UUCUUGUCCAGCUUUAUUGGC | 8 |
| AM06872-AS | usAfsgsUfcUfuUfcAfgGfgAfaCfuGfaAfsg | 380 | UAGUCUUUCAGGGAACUGAAG | 694 |
| AM06874-AS | usAfsgsUfcUfuUfcAfgGfgAfaCfuGfaAfsc | 381 | UAGUCUUUCAGGGAACUGAAC | 695 |
| AM06876-AS | asGfsasAfuAfcUfgUfcCfcUfuUfuAfaGfsc | 11 | AGAAUACUGUCCCUUUUAAGC | 12 |
| AM06908-AS | usCfsasCfuGfagaauAfcUfgUfcCfcusu | 382 | UCACUGAGAAUACUGUCCCUU | 689 |

TABLE 4-continued

APOC3 RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM06928-AS | usCfsasCfuGfagaauAfcUfgUfcCfgusu | 383 | UCACUGAGAAUACUGUCCGUU | 696 |
| AM06951-AS | usAfsgsUfcUfuUfcAfgGfgAfaCfuGfaCfsg | 384 | UAGUCUUUCAGGGAACUGACG | 697 |
| AM06953-AS | usAfsgsUfcUfuUfcAfgGfgAfaCfuGfaGfsg | 385 | UAGUCUUUCAGGGAACUGAGG | 698 |
| AM06956-AS | usAfsgsUfcUfuUfcAfgGfgAfaCfuGfaCfsc | 386 | UAGUCUUUCAGGGAACUGACC | 699 |
| AM06958-AS | usAfsgsUfcUfuUfcAfgGfgAfaCfuGfaGfsc | 387 | UAGUCUUUCAGGGAACUGAGC | 700 |
| AM06961-AS | asGfsasAfuAfcUfgUfcCfcUfuUfuAfgGfsc | 388 | AGAAUACUGUCCCUUUUAGGC | 701 |
| AM06963-AS | asGfsasAfuAfcUfgUfcCfcUfuUfuAfaGfsg | 389 | AGAAUACUGUCCCUUUUAAGG | 702 |
| AM06988-AS | asGfsasAfuAfcUfgUfcCfcUfuUfuAfgGfsg | 9 | AGAAUACUGUCCCUUUUAGGG | 10 |
| AM07179-AS | usGfscsAfaCfA$_{UNA}$acaaGfgAfgUfaCfccsu | 390 | UGCAACAACAAGGAGUACCCU | 589 |
| AM07182-AS | usAfsgsUfcUfuU$_{UNA}$ufcAfgGfgAfaCfuGfaAfsg | 391 | UAGUCUUUCAGGGAACUGAAG | 694 |
| AM07185-AS | asGfsasAfuAfcC$_{UNA}$UfgUfcCfcUfuUfuAfaGfsc | 392 | AGAAUACUGUCCCUUUUAAGC | 12 |
| AM07188-AS | usGfsasGfaAfU$_{UNA}$AfcUfgUfcCfcUfuUfgcsc | 393 | UGAGAAUACUGUCCCUUUGCC | 14 |
| AM07190-AS | usCfsasCfuGfA$_{UNA}$gaauAfcUfgUfcCfcUfsc | 394 | UCACUGAGAAUACUGUCCCUC | 3 |
| AM07193-AS | usUfscsUfuGfU$_{UNA}$CfcAfgCfuUfuAfuUfgGfsc | 395 | UUCUUGUCCAGCUUUAUUGGC | 8 |
| AM07518-AS | asGfsasAfuAfcUfgUfcCfcUfuUfuAfgGfsu | 396 | AGAAUACUGUCCCUUUUAGGU | 707 |
| AM07520-AS | asGfsasAfuAfcUfgUfcCfcUfuUfuAfcGfsc | 397 | AGAAUACUGUCCCUUUUACGC | 708 |
| AM07522-AS | asGfsasAfuAfcUfgUfcCfcUfuUfuAfgAfsc | 398 | AGAAUACUGUCCCUUUUAGAC | 709 |
| AM07524-AS | usCfsascugagaauAfcUfgUfcCfcUfsc | 6 | UCACUGAGAAUACUGUCCCUC | 3 |
| AM07600-AS | asGfsasauacuguCfcCfuUfuUfAfgGfsc | 399 | AGAAUACUGUCCCUUUUAGGC | 701 |
| AM07645-AS | usUfscsuuguccagCfuUfuAfuUfgGfsc | 400 | UUCUUGUCCAGCUUUAUUGGC | 8 |
| AM07750-AS | usCfsasCfuGfagaauAfcUfgUfcCfcUfsg | 401 | UCACUGAGAAUACUGUCCCUG | 710 |
| AM07753-AS | usCfsasCfuGfagaauAfcUfgUfcCfcCfsu | 402 | UCACUGAGAAUACUGUCCCCU | 711 |
| AM07755-AS | usCfsA$_{UNA}$SCfuGfagaauAfcUfgUfcCfcUfsc | 403 | UCACUGAGAAUACUGUCCCUC | 3 |
| AM07756-AS | usCfsasC$_{UNA}$uGfagaauAfcUfgUfcCfcUfsc | 404 | UCACUGAGAAUACUGUCCCUC | 3 |
| AM07757-AS | usCfsasCfU$_{UNA}$Gfagaauafcufgufccfcufsc | 405 | UCACUGAGAAUACUGUCCCUC | 3 |
| AM07758-AS | usCfsasCfuG$_{UNA}$agaauAfcUfgUfcCfcUfsc | 406 | UCACUGAGAAUACUGUCCCUC | 3 |
| AM07760-AS | asGfsusGfcAfuccuuGfgCfgGfuCfuusu | 407 | AGUGCAUCCUUGGCGGUCUUU | 712 |
| AM07762-AS | asGfsusGfcAfU$_{UNA}$ccuuGfgCfgGfuCfuusu | 408 | AGUGCAUCCUUGGCGGUCUUU | 712 |
| AM07764-AS | asGfsusAfgUfcuuucAfgGfgAfaCfuGfsa | 409 | AGUAGUCUUUCAGGGAACUGA | 713 |
| AM07765-AS | asGfsusAfgUfC$_{UNA}$uuucAfgGfgAfaCfuGfsa | 410 | AGUAGUCUUUCAGGGAACUGA | 713 |
| AM07767-AS | usGfsusAfgUfcuuucAfgGfgAfaCfuGfsa | 411 | UGUAGUCUUUCAGGGAACUGA | 714 |
| AM07769-AS | usCfsusUfaAfcggugCfuCfcAfgUfaGfsu | 412 | UCUUAACGGUGCUCCAGUAGU | 715 |
| AM07771-AS | usCfscsUfuUfuaagcAfaCfcUfaCfaGfsg | 413 | UCCUUUUAAGCAACCUACAGG | 716 |
| AM07773-AS | usCfscsUfuUfuaagcAfaCfcUfaCfaGfsc | 414 | UCCUUUUAAGCAACCUACAGC | 717 |
| AM07775-AS | usAfsgsUfcUfuucagGfgAfaCfuGfaCfsc | 415 | UAGUCUUUCAGGGAACUGACC | 699 |

TABLE 5

APOC3 RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
| --- | --- | --- | --- | --- |
| AM06206-SS | (NAG37)s(invAb)sgcaccgUfUfAfaggacaaguauus(invAb) | 416 | GCACCGUUAAGGACAAGUAUU | 718 |
| AM06207-SS | (NAG37)s(invAb)sgagcaccgUfUfAfaggacaagus(invdA) | 417 | GAGCACCGUUAAGGACAAGUA | 719 |
| AM06208-SS | (NAG37)s(invAb)sgcaccgUfUfAfaggacaagus(invdA) | 418 | GCACCGUUAAGGACAAGUA | 720 |
| AM06209-SS | (NAG37)s(invAb)sgcaccgUfUfAfaggacaaguus(invAb) | 419 | GCACCGUUAAGGACAAGUU | 721 |
| AM06212-SS | (NAG37)s(invAb)sccucaaUfAfCfcccaaguccs(invdA) | 420 | CCUCAAUACCCCAAGUCCA | 722 |
| AM06213-SS | (NAG37)s(invAb)sgaccucaaUfAfCfcccaaguccs(invdA) | 421 | GACCUCAAUACCCCAAGUCCA | 723 |
| AM06216-SS | (NAG37)s(invAb)sgcuucaGfUfUfcccugaaags(invdA) | 422 | GCUUCAGUUCCCUGAAAGA | 724 |
| AM06217-SS | (NAG37)s(invAb)sggcuucaGfUfUfcccugaaags(invdA) | 423 | GGCUUCAGUUCCCUGAAAGA | 725 |
| AM06220-SS | (NAG37)s(invAb)sgaccgaUfGfGfcuucaguucs(invdA) | 424 | GACCGAUGGCUUCAGUUCA | 726 |
| AM06221-SS | (NAG37)s(invAb)sgugaccgaUfGfGfcuucaguucs(invdA) | 425 | GUGACCGAUGGCUUCAGUUCA | 727 |
| AM06264-SS | (NAG37)s(invAb)sccaaaaggGfAfCfaguauucucs(invdA) | 426 | CCAAAAGGGACAGUAUUCUCA | 728 |
| AM06265-SS | (NAG37)scsgcaaaaggGfAfCfaguauucucs(invdA) | 427 | CGCAAAAGGGACAGUAUUCUCA | 729 |
| AM06268-SS | (NAG37)s(invAb)sgacuacUfGfGfagcaccguus(invdA) | 428 | GACUACUGGAGCACCGUUA | 730 |
| AM06269-SS | (NAG37)s(invAb)sgacuacUfGfGfagcacuguus(invdA) | 429 | GACUACUGGAGCACUGUUA | 731 |
| AM06270-SS | (NAG37)s(invAb)scgacuacUfGfGfagcaccguus(invdA) | 430 | CGACUACUGGAGCACCGUUA | 732 |
| AM06271-SS | (NAG37)s(invAb)sgacuacUfGfGfagcaucguus(invdA) | 431 | GACUACUGGAGCAUCGUUA | 733 |
| AM06274-SS | (NAG37)s(invAb)sagggacAfGfUfauucucagus(invdA) | 432 | AGGGACAGUAUUCUCAGUA | 734 |
| AM06275-SS | (NAG37)s(invAb)scagggacAfGfUfauucucagus(invdA) | 433 | CAGGGACAGUAUUCUCAGUA | 735 |
| AM06278-SS | (NAG37)s(invAb)sgacuacuGfGfAfgcaccguuas(invdA) | 434 | GACUACUGGAGCACCGUUAA | 736 |
| AM06279-SS | (NAG37)s(invAb)sgccuacuGfGfAfgcaccguuas(invdA) | 435 | GCCUACUGGAGCACCGUUAA | 737 |
| AM06280-SS | (NAG37)s(invAb)sgccuacuGfGfAfgcacuguuas(invdA) | 436 | GCCUACUGGAGCACUGUUAA | 738 |
| AM06311-SS | (NAG37)s(invAb)sgcugggUfGfAfccgauggcus(invdA) | 437 | GCUGGGUGACCGAUGGCUA | 739 |
| AM06312-SS | (NAG37)s(invAb)sgcugggUfGfAfccgauggcuus(invAb) | 438 | GCUGGGUGACCGAUGGCUU | 740 |
| AM06313-SS | (NAG37)s(invAb)sgcugggUfGfAfccgaugacus(invdA) | 439 | GCUGGGUGACCGAUGACUA | 741 |
| AM06316-SS | (NAG37)s(invAb)sccguuaAfGfGfacaaguucus(invdA) | 440 | CCGUUAAGGACAAGUUCUA | 742 |
| AM06317-SS | (NAG37)s(invAb)scaccguuaAfGfGfacaaguucus(invdA) | 441 | CACCGUUAAGGACAAGUUCUA | 743 |
| AM06321-SS | (NAG37)s(invAb)saccguuAfGfGfacaaguucs(invdA) | 442 | ACCGUUAAGGACAAGUUCA | 744 |
| AM06322-SS | (NAG37)s(invAb)saccguuAfAfGfgacaaguucus(invAb) | 443 | ACCGUUAAGGACAAGUUCU | 745 |
| AM06323-SS | (NAG37)s(invAb)sgcaccguuAfAfGfgacaaguucs(invdA) | 444 | GCACCGUUAAGGACAAGUUCA | 746 |
| AM06326-SS | (NAG37)s(invAb)sgguacuCfCfUfuguuguugcs(invdA) | 445 | GGUACUCCUUGUUGUUGCA | 747 |
| AM06327-SS | (NAG37)s(invAb)scggguacuCfCfUfuguuguugcs(invdA) | 446 | CGGGUACUCCUUGUUGUUGCA | 748 |
| AM06329-SS | (NAG37)s(invAb)scggguaCfUfCfcuuguuguus(invdA) | 447 | CGGGUACUCCUUGUUGUUA | 749 |
| AM06332-SS | (NAG37)s(invAb)sgggacagUfAfUfucucagugcs(invdA) | 448 | GGGACAGUAUUCUCAGUGCA | 750 |
| AM06333-SS | (NAG37)s(invAb)sgggacagUfAfUfucucagugcus(invAb) | 449 | GGGACAGUAUUCUCAGUGCU | 751 |
| AM06470-SS | (NAG37)sgscaccgUfUfAfaggacaaguuuus(invAb) | 450 | GCACCGUUAAGGACAAGUUUU | 752 |
| AM06473-SS | (NAG37)sgsagcaccgUfUfAfaggacaagus(invdA) | 451 | GAGCACCGUUAAGGACAAGUA | 719 |
| AM06474-SS | (NAG37)sgsgagcaccgUfUfAfaggacaagus(invdA) | 452 | GGAGCACCGUUAAGGACAAGUA | 753 |

TABLE 5-continued

APOC3 RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM06479-SS | (NAG37)sgsagcaccgUfUfAfaggacaaguus(invAb) | 453 | GAGCACCGUUAAGGACAAGUU | 754 |
| AM06480-SS | (NAG37)sgsgagcaccgUfUfAfaggacaaguus(invAb) | 454 | GGAGCACCGUUAAGGACAAGUU | 755 |
| AM06506-SS | (NAG37)s(invAb)saaaaggGfAfCfaguauucucauus(invAb) | 455 | AAAAGGGACAGUAUUCUCAUU | 756 |
| AM06508-SS | (NAG37)s(invAb)scaaaaggGfAfCfaguauucucs(invdA) | 456 | CAAAAGGGACAGUAUUCUCA | 757 |
| AM06510-SS | (NAG37)(invAb)ccaaaaggGfAfCfaguauucuc(invdA) | 457 | CCAAAAGGGACAGUAUUCUCA | 728 |
| AM06512-SS | (NAG37)s(invAb)sccaaaaggGfAfCfaguauucucus(invAb) | 458 | CCAAAAGGGACAGUAUUCUCU | 758 |
| AM06515-SS | (NAG37)s(invAb)sgguacuCfCfUfuguuguugcauus(invAb) | 459 | GGUACUCCUUGUUGUUGCAUU | 759 |
| AM06516-SS | (NAG37)s(invAb)sggguacuCfCfUfuguuguugcs(invdA) | 460 | GGGUACUCCUUGUUGUUGCA | 760 |
| AM06520-SS | (NAG37)(invAb)gguacuCfCfUfuguuguugc(invdA) | 461 | GGUACUCCUUGUUGUUGCA | 747 |
| AM06522-SS | (NAG37)s(invAb)sgguacuCfCfUfuguuguugcus(invAb) | 462 | GGUACUCCUUGUUGUUGCU | 761 |
| AM06711-SS | (NAG37)s(invAb)sugggugacCfGfAfuggcuucagas(invAb) | 463 | UGGGUGACCGAUGGCUUCAGA | 762 |
| AM06713-SS | (NAG37)s(invAb)sugggugacCfGfAfuggcuucagus(invAb) | 464 | UGGGUGACCGAUGGCUUCAGU | 763 |
| AM06715-SS | (NAG37)s(invAb)sugaccgauGfGfCfuucaguuccas(invAb) | 465 | UGACCGAUGGCUUCAGUUCCA | 764 |
| AM06717-SS | (NAG37)s(invAb)sggaccgauGfGfCfuucaguuccas(invAb) | 466 | GGACCGAUGGCUUCAGUUCCA | 765 |
| AM06719-SS | (NAG37)s(invAb)sgcuucagUfUfCfccugaaagaas(invAb) | 467 | GGCUUCAGUUCCCUGAAAGAA | 766 |
| AM06721-SS | (NAG37)s(invAb)sgacuacugGfAfGfcaccguuaaas(invAb) | 468 | GACUACUGGAGCACCGUUAAA | 767 |
| AM06723-SS | (NAG37)s(invAb)scuacuggaGfCfAfccguuaaggas(invAb) | 469 | CUACUGGAGCACCGUUAAGGA | 768 |
| AM06725-SS | (NAG37)s(invAb)suacuggagCfAfCfcguuaaggaas(invAb) | 470 | UACUGGAGCACCGUUAAGGAA | 769 |
| AM06727-SS | (NAG37)s(invAb)sgacuggagCfAfCfcguuaaggaas(invAb) | 471 | GACUGGAGCACCGUUAAGGAA | 770 |
| AM06729-SS | (NAG37)s(invAb)sgagcaccgUfUfAfaggacaaguas(invAb) | 472 | GAGCACCGUUAAGGACAAGUA | 719 |
| AM06731-SS | (NAG37)s(invAb)sgagcaccgUfUfAfaggacaaguus(invAb) | 473 | GAGCACCGUUAAGGACAAGUU | 754 |
| AM06733-SS | (NAG37)s(invAb)saguggcugCfCfUfgagaccucaas(invAb) | 474 | AGUGGCUGCCUGAGACCUCAA | 771 |
| AM06735-SS | (NAG37)s(invAb)sggcugccuGfAfGfaccucaauaas(invAb) | 475 | GGCUGCCUGAGACCUCAAUAA | 772 |
| AM06737-SS | (NAG37)s(invAb)sgcugccugAfGfAfccucaauacas(invAb) | 476 | GCUGCCUGAGACCUCAAUACA | 773 |
| AM06739-SS | (NAG37)s(invAb)saagggacaGfUfAfuucucagugas(invAb) | 477 | AAGGGACAGUAUUCUCAGUGA | 774 |
| AM06742-SS | (NAG37)s(invAb)sacgggacaGfUfAfuucucagugas(invAb) | 478 | ACGGGACAGUAUUCUCAGUGA | 775 |
| AM06744-SS | (NAG37)s(invAb)sccccuguagGfUfUfgcuuaaagas(invAb) | 479 | CCCUGUAGGUUGCUUAAAGA | 776 |
| AM06779-SS | (NAG37)s(invAb)sggaaaaggGfAfCfaguauucucas(invAb) | 480 | GGAAAAGGGACAGUAUUCUCA | 777 |
| AM06781-SS | (NAG37)gsgaaaaggGfAfCfaguauucucas(invAb) | 481 | GGAAAAGGGACAGUAUUCUCA | 777 |
| AM06782-SS | (NAG37)s(invAb)sgagggacaGfUfAfuucucagugas(invAb) | 482 | GAGGGACAGUAUUCUCAGUGA | 21 |
| AM06785-SS | (NAG37)s(invAb)sggcaaaggGfAfCfaguauucucas(invAb) | 483 | GGCAAAGGGACAGUAUUCUCA | 31 |
| AM06787-SS | (NAG37)gsgcaaaggGfAfCfaguauucucas(invAb) | 484 | GGCAAAGGGACAGUAUUCUCA | 31 |
| AM06788-SS | (NAG37)s(invAb)susgaccgauGfGfCfuucaiuuccas(invAb) | 485 | UGACCGAUGGCUUCAIUUCCA | 780 |
| AM06789-SS | (NAG37)usgaccgauGfGfCfuucaguuccas(invAb) | 486 | UGACCGAUGGCUUCAGUUCCA | 764 |
| AM06790-SS | (NAG37)usgaccgauGfGfCfuucaiuuccas(invAb) | 487 | UGACCGAUGGCUUCAIUUCCA | 780 |
| AM06791-SS | (NAG37)gsagggacaGfUfAfuucucagugas(invAb) | 488 | GAGGGACAGUAUUCUCAGUGA | 21 |

TABLE 5-continued

APOC3 RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM06792-SS | (NAG37)gsgcugccuGfAfGfaccucaauaas(invAb) | 489 | GGCUGCCUGAGACCUCAAUAA | 772 |
| AM06863-SS | (NAG37)s(invAb)sgga_2NaaaggGfAfCfaguauucucas(invAb) | 490 | GG(A$^{2N}$)AAAGGGACAGUAUUCUCA | 781 |
| AM06864-SS | (NAG37)s(invAb)sa_2NgaaaaggGfAfCfaguauucucas(invAb) | 491 | (A$^{2N}$)GAAAAGGGACAGUAUUCUCA | 782 |
| AM06866-SS | (NAG37)s(invAb)sa_2Na_2NaaaaggGfAfCfaguauucucas(invAb) | 492 | (A$^{2N}$)(A$^{2N}$)AAAAGGGACAGUAUUCUCA | 783 |
| AM06867-SS | (NAG37)s(invAb)scccaauaaAfGfCfuggacaagaas(invAb) | 493 | CCCAAUAAAGCUGGACAAGAA | 784 |
| AM06869-SS | (NAG37)s(invAb)sgccaauaaAfGfCfuggacaagaas(invAb) | 494 | GCCAAUAAAGCUGGACAAGAA | 23 |
| AM06871-SS | (NAG37)s(invAb)scuucaguuCfCfCfugaaagacuas(invAb) | 495 | CUUCAGUUCCCUGAAAGACUA | 786 |
| AM06873-SS | (NAG37)s(invAb)sguucaguuCfCfCfugaaagacuas(invAb) | 496 | GUUCAGUUCCCUGAAAGACUA | 787 |
| AM06875-SS | (NAG37)s(invAb)sgcuuaaaaGfGfGfacaguauucus(invAb) | 497 | GCUUAAAAGGGACAGUAUUCU | 29 |
| AM06907-SS | (NAG37)s(invAb)sgggacaGfUfAfuucucagugauus(invAb) | 498 | GGGACAGUAUUCUCAGUGAUU | 789 |
| AM06922-SS | (NAG37)s(invAb)sa_2NagggacaGfUfAfuucucagugas(invAb) | 499 | (A$^{2N}$)AGGGACAGUAUUCUCAGUGA | 790 |
| AM06923-SS | (NAG37)s(invAb)sgagggacaGfUfAfuucucaiugas(invAb) | 500 | GAGGGACAGUAUUCUCAIUGA | 791 |
| AM06924-SS | (NAG37)s(invAb)sgagggacaGfUfAfuucucaguias(invAb) | 501 | GAGGGACAGUAUUCUCAGUIA | 16 |
| AM06925-SS | (NAG37)ascgggacaGfUfAfuucucagugas(invAb) | 502 | ACGGGACAGUAUUCUCAGUGA | 775 |
| AM06926-SS | (NAG37)gsggacaGfUfAfuucucagugauus(invAb) | 503 | GGGACAGUAUUCUCAGUGAUU | 789 |
| AM06927-SS | (NAG37)s(invAb)scggacaGfUfAfuucucagugauus(invAb) | 504 | CGGACAGUAUUCUCAGUGAUU | 793 |
| AM06929-SS | (NAG37)gsgcaaaggGfAfCfaGuauucucas(invAb) | 505 | GGCAAAGGGACAGUAUUCUCA | 31 |
| AM06932-SS | (NAG37)s(invAb)sggcaaagiGfAfCfaguauucucas(invAb) | 506 | GGCAAAGIGACAGUAUUCUCA | 794 |
| AM06933-SS | (NAG37)s(invAb)sggcaaaigGfAfCfaguauucucas(invAb) | 507 | GGCAAAIGGACAGUAUUCUCA | 778 |
| AM06934-SS | (NAG37)s(invAb)sagggacuCfCfUfuguuguugcas(invAb) | 508 | AGGGUACUCCUUGUUGUUGCA | 795 |
| AM06948-SS | (NAG37)s(invAb)scuucaguuCfUfCfugaaagacuas(invAb) | 509 | CUUCAGUUCUCUGAAAGACUA | 796 |
| AM06949-SS | (NAG37)s(invAb)scuucaguuUfCfCfugaaagacuas(invAb) | 510 | CUUCAGUUUCCUGAAAGACUA | 797 |
| AM06950-SS | (NAG37)s(invAb)scgucaguuCfCfCfugaaagacuas(invAb) | 511 | CGUCAGUUCCCUGAAAGACUA | 798 |
| AM06952-SS | (NAG37)s(invAb)sccucaguuCfCfCfugaaagacuas(invAb) | 512 | CCUCAGUUCCCUGAAAGACUA | 799 |
| AM06954-SS | (NAG37)s(invAb)scgucaguuCfUfCfugaaagacuas(invAb) | 513 | CGUCAGUUCUCUGAAAGACUA | 800 |
| AM06955-SS | (NAG37)s(invAb)sggucaguuCfCfCfugaaagacuas(invAb) | 514 | GGUCAGUUCCCUGAAAGACUA | 801 |
| AM06957-SS | (NAG37)s(invAb)sgcucaguuCfCfCfugaaagacuas(invAb) | 515 | GCUCAGUUCCCUGAAAGACUA | 802 |
| AM06960-SS | (NAG37)s(invAb)sgccuaaaaGfGfGfacaguauucus(invAb) | 516 | GCCUAAAAGGGACAGUAUUCU | 803 |
| AM06962-SS | (NAG37)s(invAb)sccuuaaaaGfGfGfacaguauucus(invAb) | 517 | CCUUAAAAGGGACAGUAUUCU | 804 |
| AM06964-SS | (NAG37)s(invAb)sgcuuaaaaGfGfiacaguauucus(invAb) | 518 | GCUUAAAAGGIACAGUAUUCU | 805 |
| AM06965-SS | (NAG37)s(invAb)sgcuuaaaaGfiGfacaguauucus(invAb) | 519 | GCUUAAAAGIGACAGUAUUCU | 779 |
| AM06966-SS | (NAG37)s(invAb)sgcuuaaaaiGfGfacaguauucus(invAb) | 520 | GCUUAAAAIGGACAGUAUUCU | 785 |
| AM06987-SS | (NAG37)s(invAb)sccccuaaaaGfGfGfacaguauucus(invAb) | 521 | CCCUAAAAGGGACAGUAUUCU | 27 |
| AM07178-SS | (NAG37)s(invAb)sagggucuCfCfUfuguuguuicas(invAb) | 522 | AGGGUACUCCUUGUUGUUICA | 807 |
| AM07180-SS | (NAG37)s(invAb)sagggucuCfCfUfuGuuguugcas(invAb) | 523 | AGGGUACUCCUUGUUGUUGCA | 795 |
| AM07181-SS | (NAG37)s(invAb)scuucaguuCfCfCfugaaagaiuas(invAb) | 524 | CUUCAGUUCCCUGAAAGAIUA | 808 |

TABLE 5-continued

APOC3 RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM07183-SS | (NAG37)s(invAb)scuucaguuCfCfCfuGaaagacuas(invAb) | 525 | CUUCAGUUCCCUGAAAGACUA | 786 |
| AM07184-SS | (NAG37)s(invAb)sgcuuaaaaGfGfGfacaguauuius(invAb) | 526 | GCUUAAAAGGGACAGUAUUIU | 809 |
| AM07186-SS | (NAG37)s(invAb)sgcuuaaaaGfGfGfaCaguauucus(invAb) | 527 | GCUUAAAAGGGACAGUAUUCU | 29 |
| AM07187-SS | (NAG37)s(invAb)sggcaaaggGfAfCfaguauucuias(invAb) | 528 | GGCAAAGGGACAGUAUUCUIA | 810 |
| AM07189-SS | (NAG37)s(invAb)sggcaaaggGfAfCfaGuauucucas(invAb) | 529 | GGCAAAGGGACAGUAUUCUCA | 31 |
| AM07191-SS | (NAG37)s(invAb)sgagggacaGfUfAfuUcucaguias(invAb) | 530 | GAGGGACAGUAUUCUCAGUIA | 16 |
| AM07192-SS | (NAG37)s(invAb)sgccaauaaAfGfCfuggacaaiaas(invAb) | 531 | GCCAAUAAAGCUGGACAAIAA | 811 |
| AM07194-SS | (NAG37)s(invAb)sgccaauaaAfGfCfuGgacaagaas(invAb) | 532 | GCCAAUAAAGCUGGACAAGAA | 23 |
| AM07309-SS | (NAG37)s(invAb)sagggguacuCfIfUfuguuguugcas(invAb) | 533 | AGGGUACUCIUUGUUGUUGCA | 812 |
| AM07310-SS | (NAG37)s(invAb)sagggguacuIfCfUfuguuguugcas(invAb) | 534 | AGGGUACUICUUGUUGUUGCA | 788 |
| AM07311-SS | (NAG37)s(invAb)scuucaguuCfCfIfugaaagacuas(invAb) | 535 | CUUCAGUUCCIUGAAAGACUA | 813 |
| AM07312-SS | (NAG37)s(invAb)scuucaguuCfIfCfugaaagacuas(invAb) | 536 | CUUCAGUUCICUGAAAGACUA | 792 |
| AM07313-SS | (NAG37)s(invAb)scuucaguuIfCfCfugaaagacuas(invAb) | 537 | CUUCAGUUICCUGAAAGACUA | 806 |
| AM07314-SS | (NAG37)s(invAb)sgcuuaaaaGfGfIfacaguauucus(invAb) | 538 | GCUUAAAAGGIACAGUAUUCU | 805 |
| AM07315-SS | (NAG37)s(invAb)sgcuuaaaaGfIfGfacaguauucus(invAb) | 539 | GCUUAAAAGIGACAGUAUUCU | 817 |
| AM07316-SS | (NAG37)s(invAb)sgcuuaaaaIfGfGfacaguauucus(invAb) | 540 | GCUUAAAAIGGACAGUAUUCU | 824 |
| AM07317-SS | (NAG37)s(invAb)sggcaaaggGfAfIfaguauucucas(invAb) | 541 | GGCAAAGGGAIAGUAUUCUCA | 814 |
| AM07318-SS | (NAG37)s(invAb)sggcaaaggIfAfCfaguauucucas(invAb) | 542 | GGCAAAGGIACAGUAUUCUCA | 794 |
| AM07319-SS | (NAG37)s(invAb)sgagggacaIfUfAfuucucaguias(invAb) | 543 | GAGGGACAIUAUUCUCAGUIA | 815 |
| AM07320-SS | (NAG37)s(invAb)sgccaauaaAfGfIfuggacaagaas(invAb) | 544 | GCCAAUAAAGIUGGACAAGAA | 816 |
| AM07321-SS | (NAG37)s(invAb)sgccaauaaAfIfCfuggacaagaas(invAb) | 545 | GCCAAUAAAICUGGACAAGAA | 25 |
| AM07515-SS | (NAG37)s(invAb)sgccuaaaaGfGfIacaguauucus(invAb) | 546 | GCCUAAAAGGIACAGUAUUCU | 818 |
| AM07516-SS | (NAG37)s(invAb)sgccuaaaaGfGfIfacaguauucus(invAb) | 547 | GCCUAAAAGGIACAGUAUUCU | 818 |
| AM07517-SS | (NAG37)s(invAb)saccuaaaaGfGfGfacaguauucus(invAb) | 548 | ACCUAAAAGGGACAGUAUUCU | 819 |
| AM07519-SS | (NAG37)s(invAb)sgcguaaaaGfGfGfacaguauucus(invAb) | 549 | GCGUAAAAGGGACAGUAUUCU | 820 |
| AM07521-SS | (NAG37)s(invAb)sgucuaaaaGfGfGfacaguauucus(invAb) | 550 | GUCUAAAAGGGACAGUAUUCU | 821 |
| AM07523-SS | (NAG37)s(invAb)sgagggacaGfUfAfuUcucagugas(invAb) | 551 | GAGGGACAGUAUUCUCAGUGA | 21 |
| AM07525-SS | (NAG37)s(invAb)sgggacaGfUfAfuucucaguiauus(invAb) | 552 | GGGACAGUAUUCUCAGUIAUU | 822 |
| AM07526-SS | (NAG37)s(invAb)sgccaauaaAfGfCfudGgacaagaas(invAb) | 553 | GCCAAUAAAGCUGGACAAGAA | 23 |
| AM07598-SS | (NAG37)s(invAb)sgccuaaaaGfgGfaCfaguauucus(invAb) | 554 | GCCUAAAAGGGACAGUAUUCU | 803 |
| AM07599-SS | (NAG37)s(invAb)sgccuaaaaGfgIfaCfaguauucus(invAb) | 555 | GCCUAAAAGGIACAGUAUUCU | 818 |
| AM07601-SS | (NAG37)s(invAb)sgagggacaGfuAfuUfcucagugas(invAb) | 556 | GAGGGACAGUAUUCUCAGUGA | 21 |
| AM07602-SS | (NAG37)s(invAb)sgagggacaGfuAfuUfcucaguias(invAb) | 557 | GAGGGACAGUAUUCUCAGUIA | 16 |
| AM07644-SS | (NAG37)s(invAb)sgcCfaAfUfAfaAfGfCfuggacaagaas(invAb) | 558 | GCCAAUAAAGCUGGACAAGAA | 23 |
| AM07646-SS | (NAG37)s(invAb)sgcCfaAfuAfaAfgCfuggacaagaas(invAb) | 559 | GCCAAUAAAGCUGGACAAGAA | 23 |
| AM07647-SS | (NAG37)s(invAb)sgcCfaAfUfAfaAfGfCfuggacaagaas(invAb) | 560 | GCCAAUAAAGCUGGACAAGAA | 23 |

TABLE 5-continued

APOC3 RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM07648-SS | (NAG37)s(invAb)sgccaauaAMAfGfCfuggacaagaas(invAb) | 561 | GCCAAUAAAGCUGGACAAGAA | 23 |
| AM07649-SS | (NAG37)s(invAb)sgccAMauaaAfGfCfuggacaagaas(invAb) | 562 | GCCAAUAAAGCUGGACAAGAA | 23 |
| AM07650-SS | (NAG37)s(invAb)sgcCfaAfuAfaAfIfCfuggacaagaas(invAb) | 563 | GCCAAUAAAICUGGACAAGAA | 25 |
| AM07651-SS | (NAG37)s(invAb)sgcCfaAfUfAfaAfIfCfuggacaagaas(invAb) | 564 | GCCAAUAAAICUGGACAAGAA | 25 |
| AM07652-SS | (NAG37)s(invAb)sgccaauaaAfiCfuggacaagaas(invAb) | 565 | GCCAAUAAAICUGGACAAGAA | 25 |
| AM07653-SS | (NAG37)s(invAb)sgcCfaAfuAfaAfGfCfuigacaagaas(invAb) | 566 | GCCAAUAAAGCUIGACAAGAA | 823 |
| AM07654-SS | (NAG37)s(invAb)sgcCfaAfuAfaAfGfCfugiacaagaas(invAb) | 567 | GCCAAUAAAGCUGIACAAGAA | 836 |
| AM07655-SS | (NAG37)s(invAb)sgcCfuAfaAfaGfGfGfacaguauucus(invAb) | 568 | GCCUAAAAGGGACAGUAUUCU | 803 |
| AM07656-SS | (NAG37)s(invAb)sgcCfuAfaAfaGfgGfacaguauucus(invAb) | 569 | GCCUAAAAGGGACAGUAUUCU | 803 |
| AM07657-SS | (NAG37)s(invAb)sgcCfuAfaAfaGfGfifacaguauucus(invAb) | 570 | GCCUAAAAGGIACAGUAUUCU | 818 |
| AM07658-SS | (NAG37)s(invAb)sgcCfuAfaAfaGfgIfacaguauucus(invAb) | 571 | GCCUAAAAGGIACAGUAUUCU | 818 |
| AM07748-SS | (NAG37)s(invAb)sacgggacaGfUfAfuucucaguias(invAb) | 572 | ACGGGACAGUAUUCUCAGUIA | 18 |
| AM07749-SS | (NAG37)s(invAb)scagggacaGfUfAfuucucagugas(invAb) | 573 | CAGGGACAGUAUUCUCAGUGA | 825 |
| AM07751-SS | (NAG37)s(invAb)scagggacaGfUfAfuucucaguias(invAb) | 574 | CAGGGACAGUAUUCUCAGUIA | 837 |
| AM07752-SS | (NAG37)s(invAb)saggggacaGfUfAfuucucagugas(invAb) | 575 | AGGGGACAGUAUUCUCAGUGA | 826 |
| AM07754-SS | (NAG37)s(invAb)saggggacaGfUfAfuucucaguias(invAb) | 576 | AGGGGACAGUAUUCUCAGUIA | 827 |
| AM07759-SS | (NAG37)s(invAb)sagaccgCfCfAfaggaugcacuuus(invAb) | 577 | AGACCGCCAAGGAUGCACUUU | 828 |
| AM07761-SS | (NAG37)s(invAb)sagaccgCfCfAfaggauicacuuus(invAb) | 578 | AGACCGCCAAGGAUICACUUU | 829 |
| AM07763-SS | (NAG37)s(invAb)sucaguuccCfUfGfaaagacuacus(invAb) | 579 | UCAGUUCCCUGAAAGACUACU | 830 |
| AM07766-SS | (NAG37)s(invAb)sucaguuccCfUfGfaaagacuacas(invAb) | 580 | UCAGUUCCCUGAAAGACUACA | 831 |
| AM07768-SS | (NAG37)s(invAb)sacuacuggAfGfCfacciuuaagas(invAb) | 581 | ACUACUGGAGCACCIUUAAGA | 832 |
| AM07770-SS | (NAG37)s(invAb)sccuguaggUfUfGfcuuaaaaggas(invAb) | 582 | CCUGUAGGUUGCUUAAAAGGA | 833 |
| AM07772-SS | (NAG37)s(invAb)sgcuguaggUfUfGfcuuaaaaggas(invAb) | 583 | GCUGUAGGUUGCUUAAAAGGA | 834 |
| AM07774-SS | (NAG37)s(invAb)sggucaguuCfUfCfugaaagacuas(invAb) | 584 | GGUCAGUUCUCUGAAAGACUA | 835 |

($A^{2N}$) = 2-aminoadenine nucleotide

The APOC3 RNAi agents described herein are formed by annealing an antisense strand with a sense strand. A sense strand containing a sequence listed in Table 2, Table 3, or Table 5 can be hybridized to any antisense strand containing a sequence listed in Table 2, Table 3, or Table 4, provided the two sequences have a region of at least 85% complementarity over a contiguous 16, 17, 18, 19, 20, or 21 nucleotide sequence.

In some embodiments, the antisense strand of an APOC3 RNAi agent disclosed herein differs by 0, 1, 2, or 3 nucleotides from any of the antisense strand sequences in Table 4. In some embodiments, the sense strand of an APOC3 RNAi agent disclosed herein differs by 0, 1, 2, or 3 nucleotides from any of the sense strand sequences in Table 5.

In some embodiments, an APOC3 RNAi agent antisense strand comprises a nucleotide sequence of any of the sequences in Table 2, Table 3, or Table 4. In some embodiments, an APOC3 RNAi agent antisense strand comprises the sequence of nucleotides (from 5' end→3' end) 1-17, 2-17, 1-18, 2-18, 1-19, 2-19, 1-20, 2-20, 1-21, 2-21, 1-22, 2-22, 1-23, 2-23, 1-24, or 2-24, 1-25, 2-25, 1-16, or 2-16 of any of the sequences in Table 2, Table 3, or Table 4. In certain embodiments. an APOC3 RNAi agent antisense strand comprises or consists of a modified sequence of any one of the modified sequences in Table 4. In certain embodiments, an APOC3 RNAi agent antisense strand comprises or consists of a modified sequence of any one of the modified sequences in Table 3.

In some embodiments, an APOC3 RNAi agent sense strand comprises the nucleotide sequence of any of the sequences in Table 2, Table 3, or Table 5. In some embodiments, an APOC3 RNAi agent sense strand comprises the sequence of nucleotides (from 5' end 4 3' end) 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, 4-21, 1-22, 2-22, 3-22, 4-22, 1-23, 2-23, 3-23, 4-23, 1-24, 2-24, 3-24, 4-24, 1-25, 2-25, 3-25, 4-25, 1-26, 2-26, 3-26, or 4-26, of any of the sequences in Table 2, Table 3, or Table 5. In certain embodiments, an APOC3 RNAi agent sense strand comprises or consists of a modified sequence of any one of the modified sequences in Table 5. In certain embodiments, an APOC3 RNAi agent sense strand comprises or consists of a modified sequence of any one of the modified sequences in Table 3.

For the APOC3 RNAi agents disclosed herein, the nucleotide at position 1 of the antisense strand (from 5' end→3' end) can be perfectly complementary to an APOC3 gene, or can be non-complementary to an APOC3 gene. In some embodiments, the nucleotide at position 1 of the antisense strand (from 5' end→3' end) is a U, A, or dT (or a modified version thereof). In some embodiments, the nucleotide at position 1 of the antisense strand (from 5' end→3' end) forms an A:U or U:A base pair with the sense strand.

In some embodiments, an APOC3 RNAi agent antisense strand comprises the sequence of nucleotides (from 5' end→3' end) 2-18 or 2-19 of any of the antisense strand sequences in Table 2 or Table 4. In some embodiments, an APOC3 RNAi sense strand comprises the sequence of nucleotides (from 5' end→3' end) 1-17 or 1-18 of any of the sense strand sequences in Table 2 or Table 5.

In some embodiments, an APOC3 RNAi agent includes (i) an antisense strand comprising the sequence of nucleotides (from 5' end→3' end) 2-18 or 2-19 of any of the antisense strand sequences in Table 2, Table 3, or Table 4, and (ii) a sense strand comprising the sequence of nucleotides (from 5' end→3' end) 1-17 or 1-18 of any of the sense strand sequences in Table 2, Table 3, or Table 5.

A sense strand containing a sequence listed in Table 2, Table 3, or Table 5 can be hybridized to any antisense strand containing a sequence listed in Table 2, Table 3, or Table 4, provided the two sequences have a region of at least 85% complementarity over a contiguous 16, 17, 18, 19, 20, or 21 nucleotide sequence. In some embodiments, the APOC3 RNAi agent has a sense strand consisting of the modified sequence of any of the modified sequences in Table 5, and an antisense strand consisting of the modified sequence of any of the modified sequences in Table 4. Representative sequence pairings are exemplified by the Duplex ID Nos. shown in Table 3 and Table 6.

In some embodiments, an APOC3 RNAi agent comprises any of the duplexes represented by any of the Duplex ID Nos. presented herein. In some embodiments, an APOC3 RNAi agent consists of any of the duplexes represented by any of the Duplex ID Nos. presented herein. In some embodiments, an APOC3 RNAi agent comprises the sense strand and antisense strand nucleotide sequences of any of the duplexes represented by any of the Duplex ID Nos. presented herein. In some embodiments, an APOC3 RNAi agent includes the sense strand and antisense strand nucleotide sequences of any of the duplexes represented by any of the Duplex ID Nos. presented herein and a targeting group and/or linking group, wherein the targeting group and/or linking group is covalently linked (i.e., conjugated) to the sense strand or the antisense strand. In some embodiments, an APOC3 RNAi agent includes the sense strand and antisense strand modified nucleotide sequences of any of the duplexes represented by any of the Duplex ID Nos. presented herein. In some embodiments, an APOC3 RNAi agent comprises the sense strand and antisense strand modified nucleotide sequences of any of the duplexes represented by any of the Duplex ID Nos. presented herein and a targeting group and/or linking group, wherein the targeting group and/or linking group is covalently linked to the sense strand or the antisense strand.

In some embodiments, an APOC3 RNAi agent comprises an antisense strand and a sense strand having the nucleotide sequences of any of the antisense strand/sense strand duplexes of Table 2, Table 3, or Table 6, and comprises an asialoglycoprotein receptor ligand targeting group.

In some embodiments, an APOC3 RNAi agent comprises an antisense strand and a sense strand having the nucleotide sequences of any of the antisense strand/sense strand duplexes of Table 2, Table 3, or Table 6, and further comprises a targeting group selected from the group consisting of (NAG13), (NAG13)s, (NAG18), (NAG18)s, (NAG24), (NAG24)s, (NAG25), (NAG25)s, (NAG26), (NAG26)s, (NAG27), (NAG27)s, (NAG28), (NAG28)s, (NAG29), (NAG29)s, (NAG30), (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), (NAG39)s. In some embodiments, the targeting group is (NAG25) or (NAG25)s as defined in Table 7. In other embodiments, the targeting group is (NAG37) or (NAG37)s as defined in Table 7.

In some embodiments, an APOC3 RNAi agent comprises an antisense strand and a sense strand having the modified nucleotide sequence of any of the antisense strand and/or sense strand nucleotide sequences of any of the duplexes of Table 2, Table 3, or Table 6.

In some embodiments, an APOC3 RNAi agent comprises an antisense strand and a sense strand having a modified nucleotide sequence of any of the antisense strand and/or sense strand nucleotide sequences of any of the duplexes of Table 2, Table 3, or Table 6, and comprises an asialoglycoprotein receptor ligand targeting group.

In some embodiments, an APOC3 RNAi agent comprises any of the duplexes of Table 2, Table 3, or Table 6.

In some embodiments, an APOC3 RNAi agent consists of any of the duplexes of Table 2, Table 3, or Table 6.

TABLE 6

APOC3 RNAi Agents Identified by Duplex ID NO. with Corresponding Sense and Antisense Strands.

| Duplex ID | Antisense Strand ID | Sense Strand ID |
| --- | --- | --- |
| AD04812 | AM06203-AS | AM06206-SS |
| AD04813 | AM06204-AS | AM06207-SS |
| AD04814 | AM06203-AS | AM06208-SS |
| AD04815 | AM06205-AS | AM06209-SS |
| AD04816 | AM06210-AS | AM06212-SS |
| AD04817 | AM06211-AS | AM06213-SS |
| AD04818 | AM06214-AS | AM06216-SS |
| AD04819 | AM06215-AS | AM06217-SS |
| AD04820 | AM06218-AS | AM06220-SS |
| AD04821 | AM06219-AS | AM06221-SS |
| AD04860 | AM06262-AS | AM06264-SS |
| AD04861 | AM06263-AS | AM06265-SS |
| AD04862 | AM06266-AS | AM06268-SS |
| AD04863 | AM06266-AS | AM06269-SS |
| AD04864 | AM06267-AS | AM06270-SS |
| AD04865 | AM06266-AS | AM06271-SS |
| AD04866 | AM06272-AS | AM06274-SS |
| AD04867 | AM06273-AS | AM06275-SS |
| AD04868 | AM06276-AS | AM06278-SS |
| AD04869 | AM06277-AS | AM06279-SS |
| AD04870 | AM06277-AS | AM06280-SS |
| AD04886 | AM06309-AS | AM06311-SS |
| AD04887 | AM06310-AS | AM06312-SS |
| AD04888 | AM06309-AS | AM06313-SS |
| AD04889 | AM06314-AS | AM06316-SS |

TABLE 6-continued

APOC3 RNAi Agents Identified by Duplex ID NO. with Corresponding Sense and Antisense Strands.

| Duplex ID | Antisense Strand ID | Sense Strand ID |
|---|---|---|
| AD04890 | AM06315-AS | AM06317-SS |
| AD04891 | AM06318-AS | AM06321-SS |
| AD04892 | AM06319-AS | AM06322-SS |
| AD04893 | AM06320-AS | AM06323-SS |
| AD04894 | AM06324-AS | AM06326-SS |
| AD04895 | AM06325-AS | AM06327-SS |
| AD04896 | AM06328-AS | AM06329-SS |
| AD04897 | AM06330-AS | AM06332-SS |
| AD04898 | AM06331-AS | AM06333-SS |
| AD04987 | AM06469-AS | AM06206-SS |
| AD04988 | AM06469-AS | AM06208-SS |
| AD04989 | AM06471-AS | AM06470-SS |
| AD04990 | AM06205-AS | AM06470-SS |
| AD04991 | AM06472-AS | AM06208-SS |
| AD04992 | AM06204-AS | AM06473-SS |
| AD04993 | AM06475-AS | AM06474-SS |
| AD04994 | AM06476-AS | AM06207-SS |
| AD04995 | AM06477-AS | AM06207-SS |
| AD04996 | AM06478-AS | AM06209-SS |
| AD04997 | AM06471-AS | AM06479-SS |
| AD04998 | AM06481-AS | AM06480-SS |
| AD05007 | AM06507-AS | AM06506-SS |
| AD05008 | AM06509-AS | AM06508-SS |
| AD05009 | AM06511-AS | AM06510-SS |
| AD05010 | AM06513-AS | AM06512-SS |
| AD05011 | AM06514-AS | AM06326-SS |
| AD05012 | AM06324-AS | AM06515-SS |
| AD05013 | AM06517-AS | AM06516-SS |
| AD05014 | AM06518-AS | AM06326-SS |
| AD05015 | AM06519-AS | AM06326-SS |
| AD05016 | AM06521-AS | AM06520-SS |
| AD05017 | AM06523-AS | AM06522-SS |
| AD05127 | AM06712-AS | AM06711-SS |
| AD05128 | AM06714-AS | AM06713-SS |
| AD05129 | AM06716-AS | AM06715-SS |
| AD05130 | AM06718-AS | AM06717-SS |
| AD05131 | AM06720-AS | AM06719-SS |
| AD05132 | AM06722-AS | AM06721-SS |
| AD05133 | AM06724-AS | AM06723-SS |
| AD05134 | AM06726-AS | AM06725-SS |
| AD05135 | AM06728-AS | AM06727-SS |
| AD05136 | AM06730-AS | AM06729-SS |
| AD05137 | AM06732-AS | AM06731-SS |
| AD05138 | AM06734-AS | AM06733-SS |
| AD05139 | AM06736-AS | AM06735-SS |
| AD05140 | AM06738-AS | AM06737-SS |
| AD05141 | AM06740-AS | AM06739-SS |
| AD05142 | AM06741-AS | AM06739-SS |
| AD05143 | AM06743-AS | AM06742-SS |
| AD05144 | AM06745-AS | AM06744-SS |
| AD05167 | AM06780-AS | AM06779-SS |
| AD05168 | AM06780-AS | AM06781-SS |
| AD05169 | AM06783-AS | AM06782-SS |
| AD05170 | AM06784-AS | AM06735-SS |
| AD05171 | AM06786-AS | AM06785-SS |
| AD05172 | AM06786-AS | AM06787-SS |
| AD05173 | AM06716-AS | AM06788-SS |
| AD05174 | AM06716-AS | AM06789-SS |
| AD05175 | AM06716-AS | AM06790-SS |
| AD05176 | AM06783-AS | AM06791-SS |
| AD05177 | AM06784-AS | AM06792-SS |
| AD05215 | AM06862-AS | AM06779-SS |
| AD05216 | AM06780-AS | AM06863-SS |
| AD05217 | AM06865-AS | AM06864-SS |
| AD05218 | AM06507-AS | AM06866-SS |
| AD05219 | AM06868-AS | AM06867-SS |
| AD05220 | AM06870-AS | AM06869-SS |
| AD05221 | AM06872-AS | AM06871-SS |
| AD05222 | AM06874-AS | AM06873-SS |
| AD05223 | AM06876-AS | AM06875-SS |
| AD05239 | AM06908-AS | AM06907-SS |
| AD05249 | AM06741-AS | AM06922-SS |
| AD05250 | AM06783-AS | AM06923-SS |
| AD05251 | AM06783-AS | AM06924-SS |
| AD05252 | AM06743-AS | AM06925-SS |
| AD05253 | AM06908-AS | AM06926-SS |
| AD05254 | AM06928-AS | AM06927-SS |
| AD05255 | AM06786-AS | AM06929-SS |
| AD05258 | AM06786-AS | AM06932-SS |
| AD05259 | AM06786-AS | AM06933-SS |
| AD05260 | AM06517-AS | AM06934-SS |
| AD05275 | AM06872-AS | AM06948-SS |
| AD05276 | AM06872-AS | AM06949-SS |
| AD05277 | AM06951-AS | AM06950-SS |
| AD05278 | AM06953-AS | AM06952-SS |
| AD05279 | AM06951-AS | AM06954-SS |
| AD05280 | AM06956-AS | AM06955-SS |
| AD05281 | AM06958-AS | AM06957-SS |
| AD05282 | AM06959-AS | AM06875-SS |
| AD05283 | AM06961-AS | AM06960-SS |
| AD05284 | AM06963-AS | AM06962-SS |
| AD05285 | AM06876-AS | AM06964-SS |
| AD05286 | AM06876-AS | AM06965-SS |
| AD05287 | AM06876-AS | AM06966-SS |
| AD05299 | AM06988-AS | AM06987-SS |
| AD05431 | AM06517-AS | AM07178-SS |
| AD05432 | AM07179-AS | AM06934-SS |
| AD05433 | AM06517-AS | AM07180-SS |
| AD05434 | AM06872-AS | AM07181-SS |
| AD05435 | AM07182-AS | AM06871-SS |
| AD05436 | AM06872-AS | AM07183-SS |
| AD05437 | AM06876-AS | AM07184-SS |
| AD05438 | AM07185-AS | AM06875-SS |
| AD05439 | AM06876-AS | AM07186-SS |
| AD05440 | AM06786-AS | AM07187-SS |
| AD05441 | AM07188-AS | AM06785-SS |
| AD05442 | AM06786-AS | AM07189-SS |
| AD05443 | AM07190-AS | AM06924-SS |
| AD05444 | AM06783-AS | AM07191-SS |
| AD05445 | AM06870-AS | AM07192-SS |
| AD05446 | AM07193-AS | AM06869-SS |
| AD05447 | AM06870-AS | AM07194-SS |
| AD05535 | AM06517-AS | AM07309-SS |
| AD05536 | AM06517-AS | AM07310-SS |
| AD05537 | AM06872-AS | AM07311-SS |
| AD05538 | AM06872-AS | AM07312-SS |
| AD05539 | AM06872-AS | AM07313-SS |
| AD05540 | AM06876-AS | AM07314-SS |
| AD05541 | AM06876-AS | AM07315-SS |
| AD05542 | AM06876-AS | AM07316-SS |
| AD05543 | AM06786-AS | AM07317-SS |
| AD05544 | AM06786-AS | AM07318-SS |
| AD05545 | AM06783-AS | AM07319-SS |
| AD05546 | AM06870-AS | AM07320-SS |
| AD05547 | AM06870-AS | AM07321-SS |
| AD05705 | AM06961-AS | AM07515-SS |
| AD05706 | AM06961-AS | AM07516-SS |
| AD05707 | AM07518-AS | AM07517-SS |
| AD05708 | AM07520-AS | AM07519-SS |
| AD05709 | AM07522-AS | AM07521-SS |
| AD05710 | AM07190-AS | AM06782-SS |
| AD05711 | AM06783-AS | AM07523-SS |
| AD05712 | AM07524-AS | AM06924-SS |
| AD05713 | AM06908-AS | AM07525-SS |
| AD05714 | AM06870-AS | AM07526-SS |
| AD05761 | AM06961-AS | AM07598-SS |
| AD05762 | AM06961-AS | AM07599-SS |
| AD05763 | AM07600-AS | AM06960-SS |
| AD05764 | AM07600-AS | AM07516-SS |
| AD05765 | AM07600-AS | AM07598-SS |
| AD05766 | AM07600-AS | AM07599-SS |
| AD05767 | AM07524-AS | AM06782-SS |
| AD05768 | AM07524-AS | AM07601-SS |
| AD05769 | AM07524-AS | AM07602-SS |
| AD05811 | AM06870-AS | AM07644-SS |
| AD05812 | AM07645-AS | AM07644-SS |
| AD05813 | AM07645-AS | AM07646-SS |
| AD05814 | AM07645-AS | AM07647-SS |

TABLE 6-continued

APOC3 RNAi Agents Identified by Duplex ID NO.
with Corresponding Sense and Antisense Strands.

| Duplex ID | Antisense Strand ID | Sense Strand ID |
|---|---|---|
| AD05815 | AM06870-AS | AM07648-SS |
| AD05816 | AM06870-AS | AM07649-SS |
| AD05817 | AM07645-AS | AM07650-SS |
| AD05818 | AM07645-AS | AM07651-SS |
| AD05819 | AM06870-AS | AM07652-SS |
| AD05820 | AM07645-AS | AM07653-SS |
| AD05821 | AM07645-AS | AM07654-SS |
| AD05822 | AM07600-AS | AM07655-SS |
| AD05823 | AM07600-AS | AM07656-SS |
| AD05824 | AM07600-AS | AM07657-SS |
| AD05825 | AM07600-AS | AM07658-SS |
| AD05876 | AM06743-AS | AM07748-SS |
| AD05877 | AM07750-AS | AM07749-SS |
| AD05878 | AM07750-AS | AM07751-SS |
| AD05879 | AM07753-AS | AM07752-SS |
| AD05880 | AM07753-AS | AM07754-SS |
| AD05881 | AM07755-AS | AM06782-SS |
| AD05882 | AM07756-AS | AM06782-SS |
| AD05883 | AM07757-AS | AM06782-SS |
| AD05884 | AM07758-AS | AM06782-SS |
| AD05885 | AM07755-AS | AM06924-SS |
| AD05886 | AM07756-AS | AM06924-SS |
| AD05887 | AM07757-AS | AM06924-SS |
| AD05888 | AM07758-AS | AM06924-SS |
| AD05889 | AM07760-AS | AM07759-SS |
| AD05890 | AM07762-AS | AM07761-SS |
| AD05891 | AM07764-AS | AM07763-SS |
| AD05892 | AM07765-AS | AM07763-SS |
| AD05893 | AM07767-AS | AM07766-SS |
| AD05894 | AM07769-AS | AM07768-SS |
| AD05895 | AM07771-AS | AM07770-SS |
| AD05896 | AM07773-AS | AM07772-SS |
| AD05897 | AM07775-AS | AM07774-SS |

In some embodiments, an APOC3 RNAi agent is prepared or provided as a salt, mixed salt, or a free-acid. The RNAi agents described herein, upon delivery to a cell expressing an APOC3 gene, inhibit or knockdown expression of one or more APOC3 genes in vivo.

Targeting Groups, Linking Groups, and Delivery Vehicles

In some embodiments, an APOC3 RNAi agent is conjugated to one or more non-nucleotide groups including, but not limited to a targeting group, linking group, delivery polymer, or a delivery vehicle. The non-nucleotide group can enhance targeting, delivery or attachment of the RNAi agent. Examples of targeting groups and linking groups are provided in Table 7. The non-nucleotide group can be covalently linked to the 3' and/or 5' end of either the sense strand and/or the antisense strand. In some embodiments, an APOC3 RNAi agent contains a non-nucleotide group linked to the 3' and/or 5' end of the sense strand. In some embodiments, anon-nucleotide group is linked to the 5' end of an APOC3 RNAi agent sense strand. A non-nucleotide group may be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the RNAi agent or conjugate. In some embodiments, a non-nucleotide group enhances endocytosis of the RNAi agent.

Targeting groups or targeting moieties can enhance the pharmacokinetic or biodistribution properties of a conjugate or RNAi agent to which they are attached to improve cell-specific distribution and cell-specific uptake of the conjugate or RNAi agent. A targeting group can be monovalent, divalent, trivalent, tetravalent, or have higher valency for the target to which it is directed. Representative targeting groups include, without limitation, compounds with affinity to cell surface molecules, cell receptor ligands, haptens, antibodies, monoclonal antibodies, antibody fragments, and antibody mimics with affinity to cell surface molecules. In some embodiments, a targeting group is linked to an RNAi agent using a linker, such as a PEG linker or one, two, or three abasic and/or ribitol (abasic ribose) residues, which in some instances can serve as linkers. In some embodiments, a targeting group comprises a galactose-derivative cluster.

The APOC3 RNAi agents described herein can be synthesized having a reactive group, such as an amine group, at the 5'-terminus. The reactive group can be used to subsequently attach a targeting group using methods typical in the art.

In some embodiments, a targeting group comprises an asialoglycoprotein receptor ligand. As used herein, an asialoglycoprotein receptor ligand is a ligand that contains a compound having affinity for the asialoglycoprotein receptor, which is highly expressed on hepatocytes. In some embodiments, an asialoglycoprotein receptor ligand includes or consists of one or more galactose derivatives. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formylgalactosamine, N-acetyl-galactosamine, N-propionyl-galactosamine, N-n-butanoyl-galactosamine, and N-iso-butanoyl-galactos-amine (see for example: S. T. Iobst and K. Drickamer, J. B. C., 1996, 271, 6686). Galactose derivatives, and clusters of galactose derivatives, that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945).

Galactose derivatives have been used to target molecules to hepatocytes in vivo through their binding to the asialoglycoprotein receptor expressed on the surface of hepatocytes. Binding of asialoglycoprotein receptor ligands to the asialoglycoprotein receptor(s) facilitates cell-specific targeting to hepatocytes and endocytosis of the molecule into hepatocytes. Asialoglycoprotein receptor ligands can be monomeric (e.g., having a single galactose derivative) or multimeric (e.g., having multiple galactose derivatives). The galactose derivative or galactose derivative cluster can be attached to the 3' or 5' end of the sense or antisense strand of the RNAi agent using methods known in the art. The preparation of targeting groups, such as galactose derivative clusters, is described in, for example, International Patent Application Publication No. WO 2018/044350 to Arrowhead Pharmaceuticals, Inc., and International Patent Application Publication No. WO 2017/156012 to Arrowhead Pharmaceuticals, Inc., the contents of both of which are incorporated by reference herein in their entirety.

As used herein, a galactose derivative cluster comprises a molecule having two to four terminal galactose derivatives. A terminal galactose derivative is attached to a molecule through its C-1 carbon. In some embodiments, the galactose derivative cluster is a galactose derivative trimer (also referred to as tri-antennary galactose derivative or tri-valent galactose derivative). In some embodiments, the galactose derivative cluster comprises N-acetyl-galactosamines. In some embodiments, the galactose derivative cluster comprises three N-acetyl-galactosamines. In some embodiments, the galactose derivative cluster is a galactose derivative tetramer (also referred to as tetra-antennary galactose derivative or tetra-valent galactose derivative). In some embodiments, the galactose derivative cluster comprises four N-acetyl-galactosamines.

As used herein, a galactose derivative trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, for example, U.S. Pat. No. 5,885,968; Biessen et al. J. Med. Chem. 1995 Vol. 39 p. 1538-1546). In some embodiments, the PEG spacer is a PEG3 spacer. The branch point can be any small molecule which permits attachment of three galactose derivatives and further permits attachment of the branch point to the RNAi agent. An example of branch point group is a di-lysine or di-glutamate. Attachment of the branch point to the RNAi agent can occur through a linker or spacer. In some embodiments, the linker or spacer comprises a flexible hydrophilic spacer, such as, but not limited to, a PEG spacer. In some embodiments, the linker comprises a rigid linker, such as a cyclic group. In some embodiments, a galactose derivative comprises or consists of N-acetyl-galactosamine. In some embodiments, the galactose derivative cluster is comprised of a galactose derivative tetramer, which can be, for example, an N-acetyl-galactosamine tetramer.

Embodiments of the present disclosure include pharmaceutical compositions for delivering an APOC3 RNAi agent to a liver cell in vivo. Such pharmaceutical compositions can include, for example, an APOC3 RNAi agent conjugated to a galactose derivative cluster.

In some embodiments, the galactose derivative cluster is comprised of a galactose derivative trimer, which can be, for example, an N-acetyl-galactosamine trimer, or galactose derivative tetramer, which can be, for example, an N-acetyl-galactosamine tetramer.

Targeting groups include, but are not limited to, (PAZ), (NAG13), (NAG13)s, (NAG18), (NAG18)s, (NAG24), (NAG24)s, (NAG25), (NAG25)s, (NAG26), (NAG26)s, (NAG27) (NAG27)s, (NAG28), (NAG28)s, (NAG29) (NAG29)s, (NAG30) (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), and (NAG39)s as defined in Table 7. Other targeting groups, including galactose cluster targeting ligands, are known in the art.

In some embodiments, a linking group is conjugated to the RNAi agent. The linking group facilitates covalent linkage of the agent to a targeting group or delivery polymer or delivery vehicle. The linking group can be linked to the 3' or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, can include, but are not limited to: reactive groups such a primary amines and alkynes, alkyl groups, abasic nucleotides, ribitol (abasic ribose), and/or PEG groups.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage may optionally include a spacer that increases the distance between the two joined atoms. A spacer can further add flexibility and/or length to the linkage. Spacers can include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

Any of the APOC3 RNAi agent nucleotide sequences listed in Tables 2, 3, 4, or 5, whether modified or unmodified, may contain 3' or 5' targeting group or linking group. Any of the APOC3 RNAi agent sequences listed in Table 4 or 5 which contain a 3' or 5' targeting group or linking group, may alternatively contain no 3' or 5' targeting group or linking group, or may contain a different 3' or 5' targeting group or linking group including, but not limited to, those depicted in Table 7. Any of the APOC3 RNAi agent duplexes listed in Table 2, Table 3, or Table 6, whether modified or unmodified, may further comprise a targeting group or linking group, including, but not limited to, those depicted in Table 7, and the targeting group or linking group may be attached to the 3' or 5' terminus of either the sense strand or the antisense strand of the APOC3 RNAi agent duplex.

Examples of targeting groups and linking groups are provided in Table 7. Table 5 provides several embodiments of APOC3 RNAi agent sense strands having a targeting group or linking group linked to the 5' or 3' end.

TABLE 7
Structure Representing Various Modified Nucleotides, Targeting Groups, and Linking Groups.
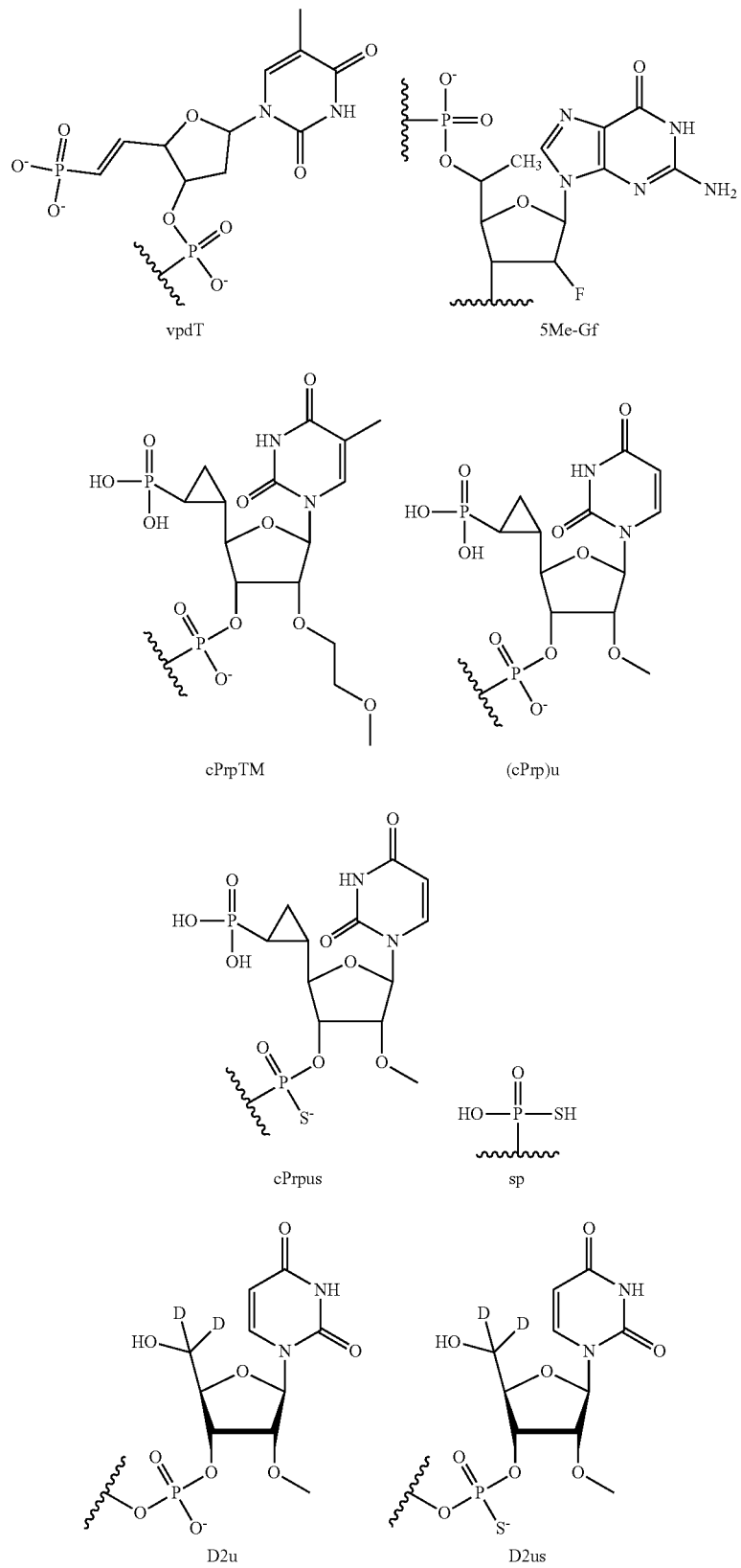

TABLE 7-continued
Structure Representing Various Modified Nucleotides, Targeting Groups, and Linking Groups.
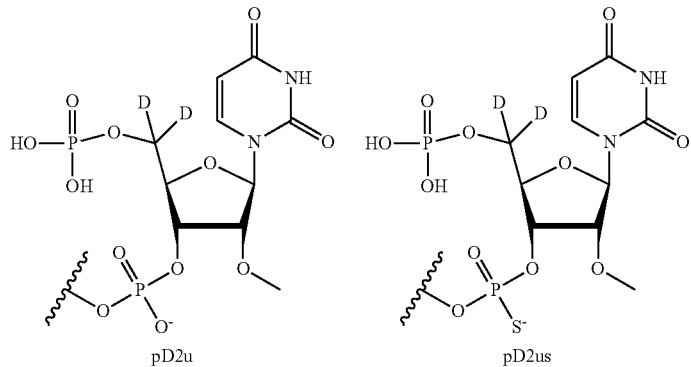
pD2u
pD2us
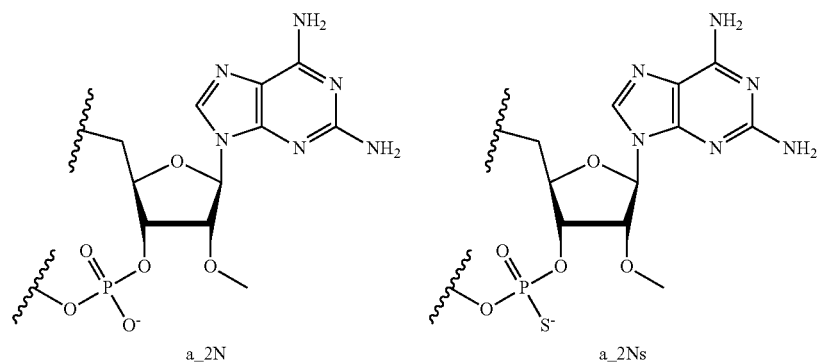
a_2N
a_2Ns
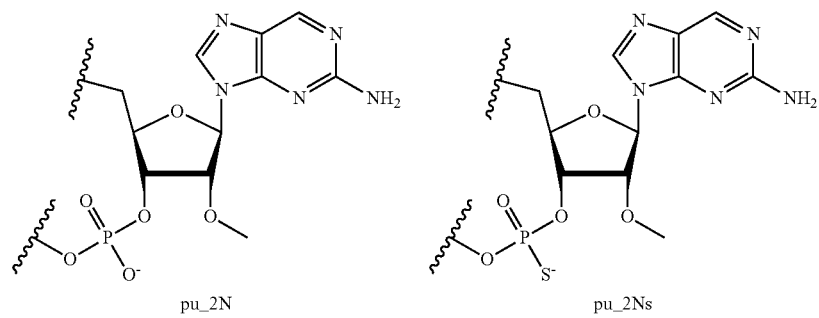
pu_2N
pu_2Ns
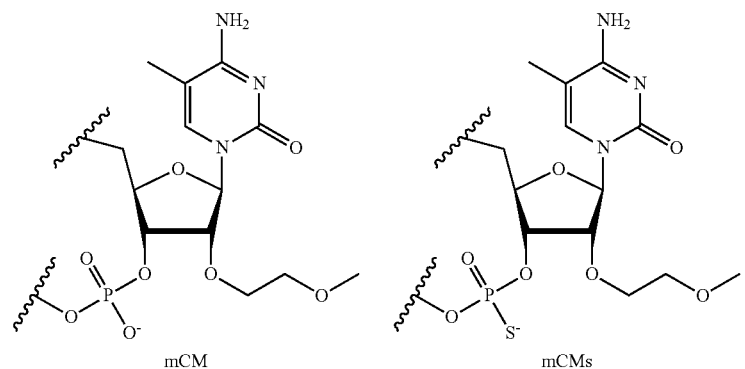
mCM
mCMs TABLE 7-continued
Structure Representing Various Modified Nucleotides, Targeting Groups, and Linking Groups.
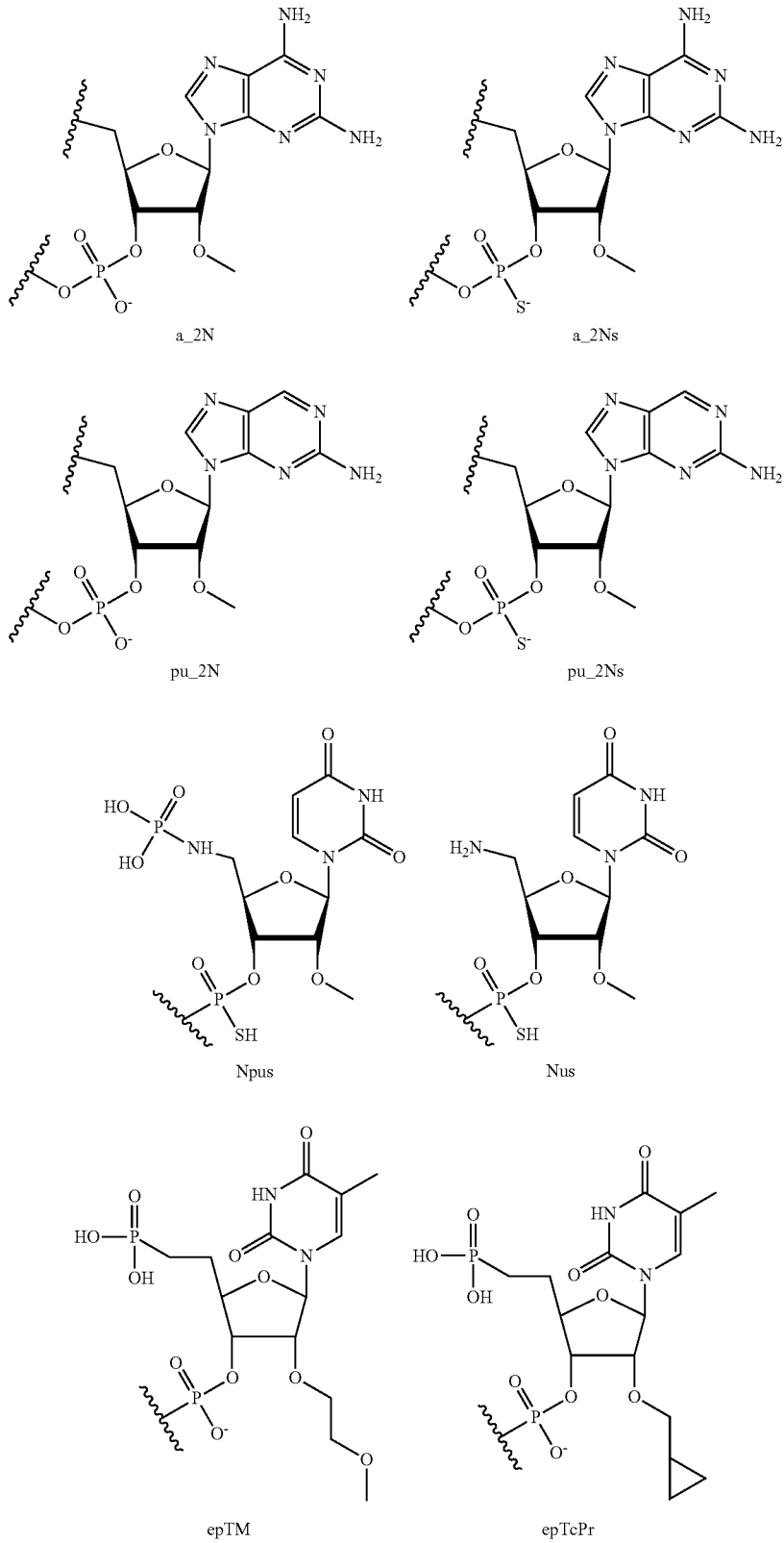
a_2N
a_2Ns
pu_2N
pu_2Ns
Npus
Nus
epTM
epTcPr TABLE 7-continued
Structure Representing Various Modified Nucleotides, Targeting Groups, and Linking Groups.
When positioned internally in oligonucleotide:
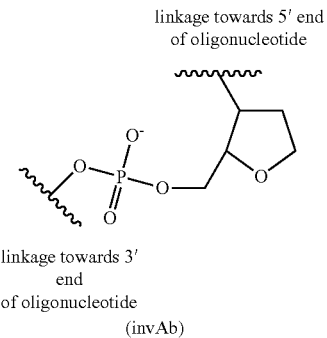 [SMILES: *OP(=O)([O-])OCC1OCCC1*]
(invAb)
When positioned internally in oligonucleotide:
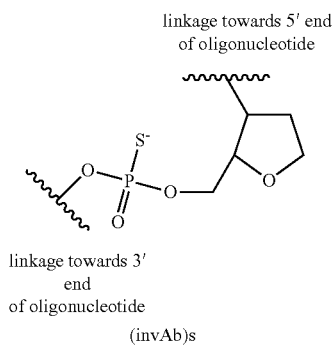
(invAb)s
When positioned at the 3' terminal end of oligonucleotide:
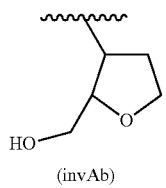
(invAb)
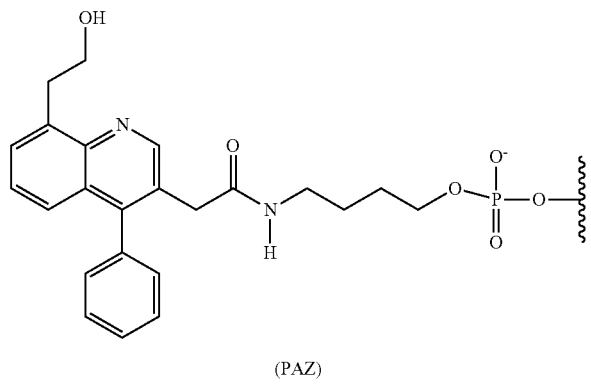 [SMILES: *OP(=O)([O-])OCCCCNC(=O)Cc1cnc2c(CCO)cccc2c1-c1ccccc1]
(PAZ)

TABLE 7-continued
Structure Representing Various Modified Nucleotides, Targeting Groups, and Linking Groups.
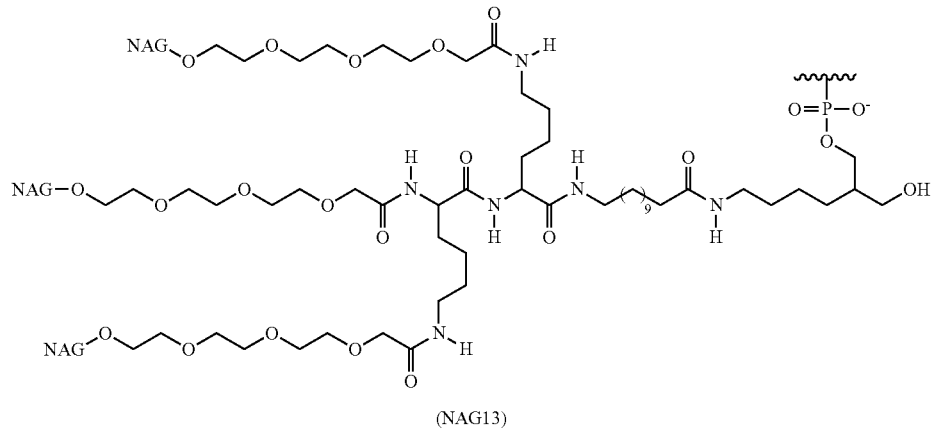
(NAG13)
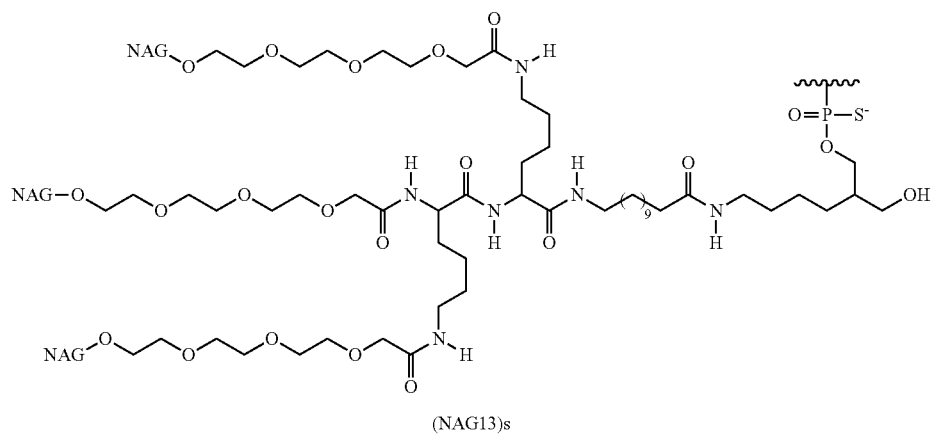
(NAG13)s
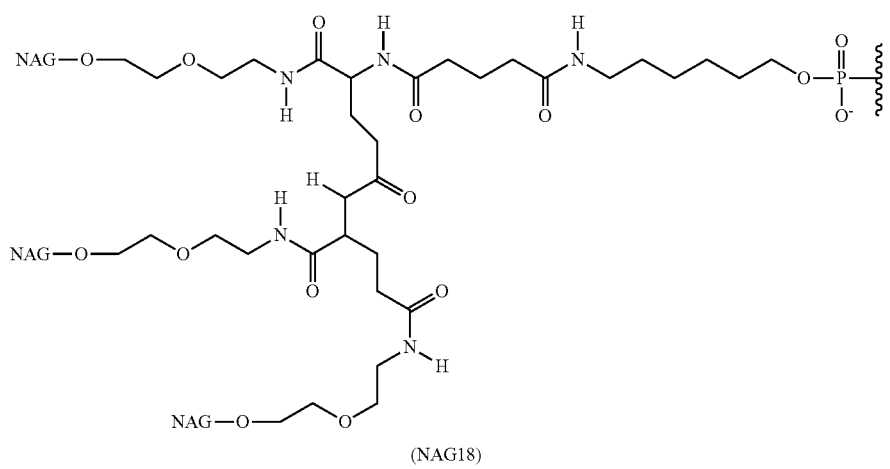
(NAG18)

TABLE 7-continued
Structure Representing Various Modified Nucleotides, Targeting Groups, and Linking Groups.
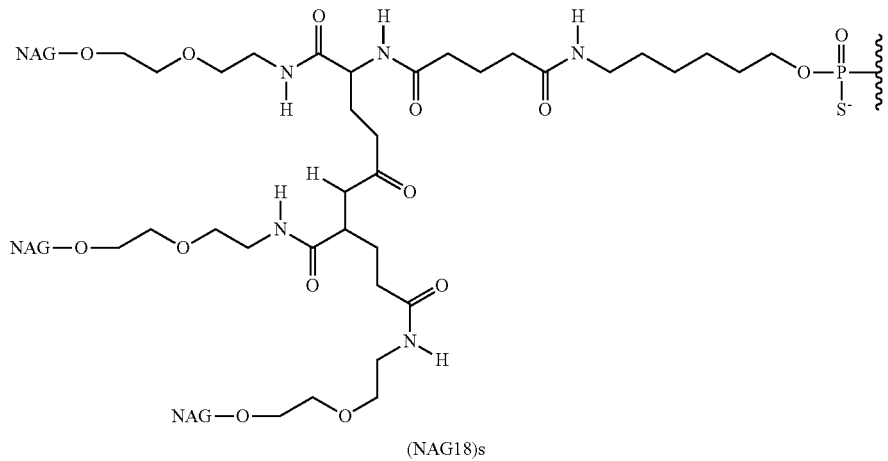
(NAG18)s
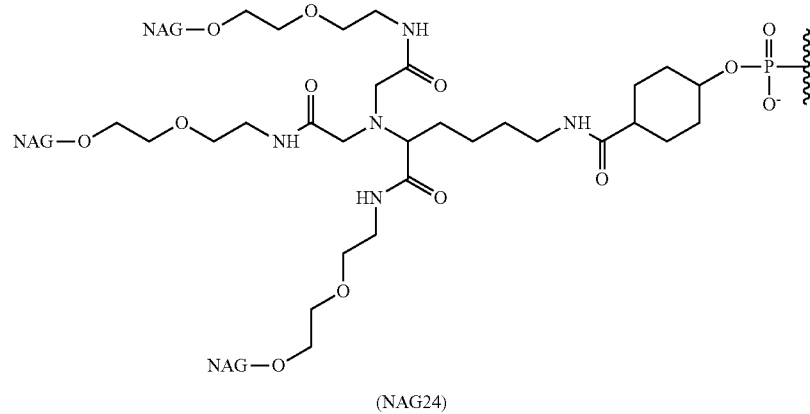
(NAG24)
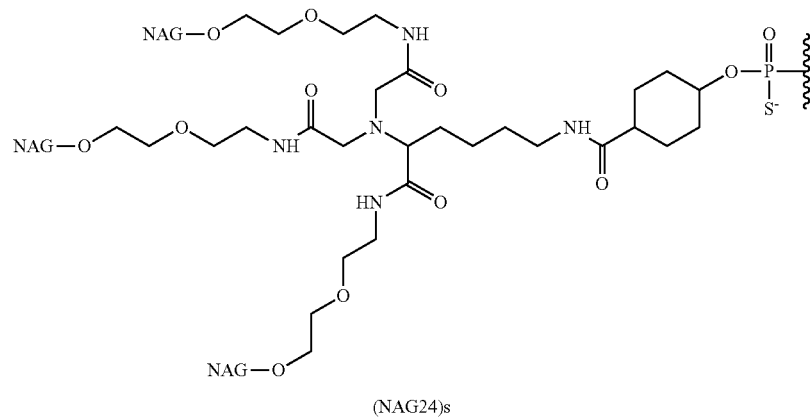
(NAG24)s TABLE 7-continued
Structure Representing Various Modified Nucleotides, Targeting Groups, and Linking Groups.
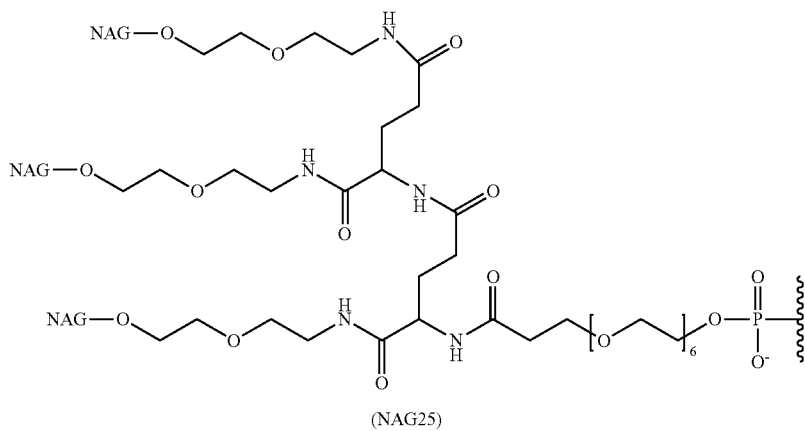
(NAG25)
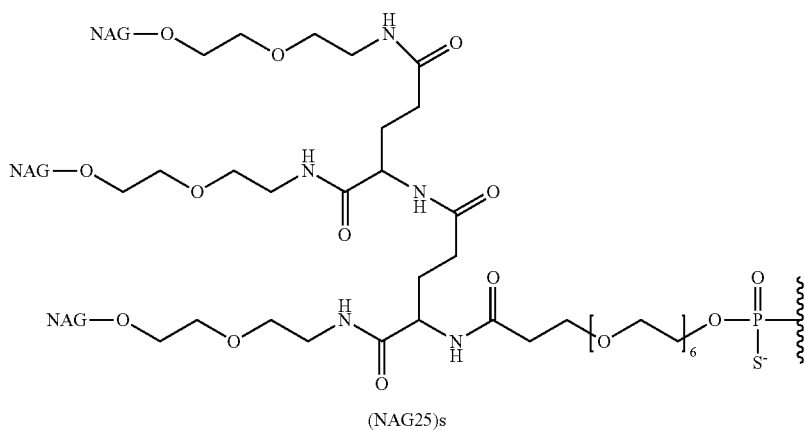
(NAG25)s
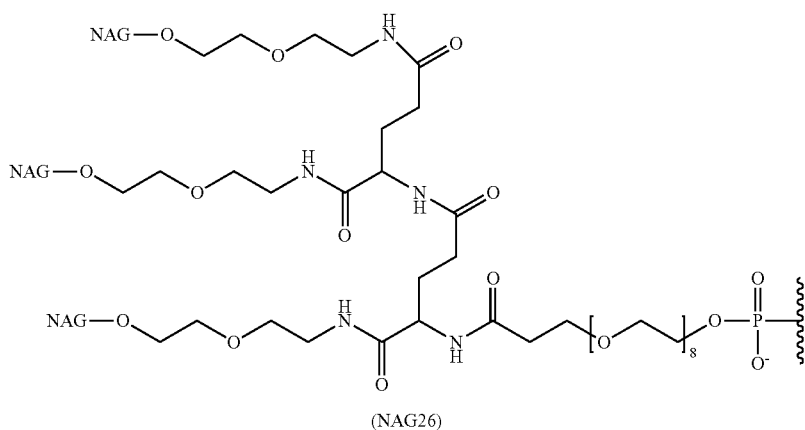
(NAG26)

TABLE 7-continued
Structure Representing Various Modified Nucleotides, Targeting Groups, and Linking Groups.
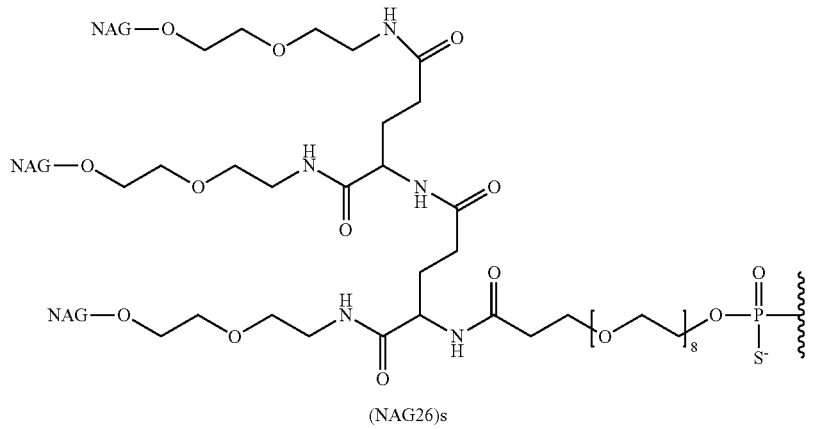
(NAG26)s
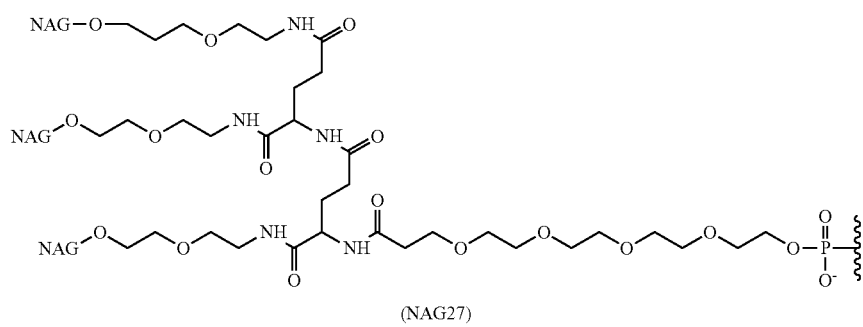
(NAG27)
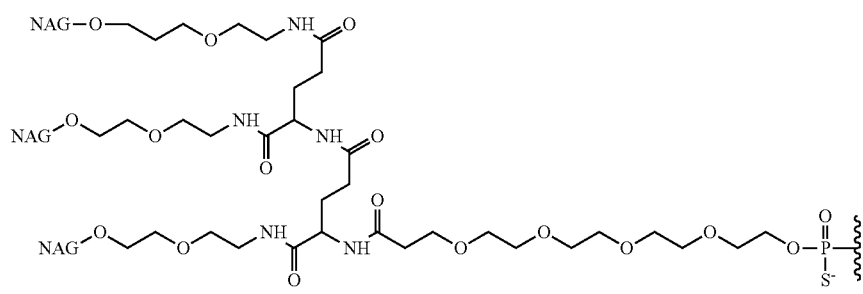
(NAG27)s
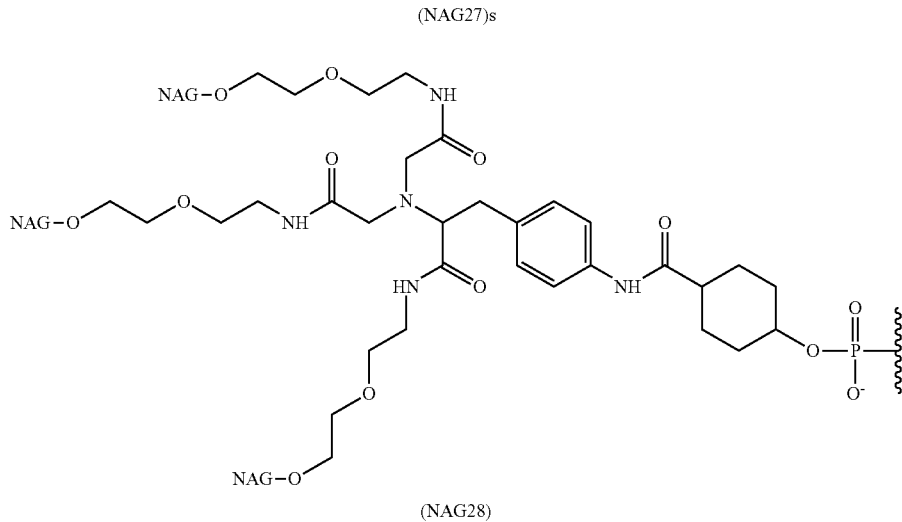
(NAG28)

TABLE 7-continued
Structure Representing Various Modified Nucleotides, Targeting Groups, and Linking Groups.
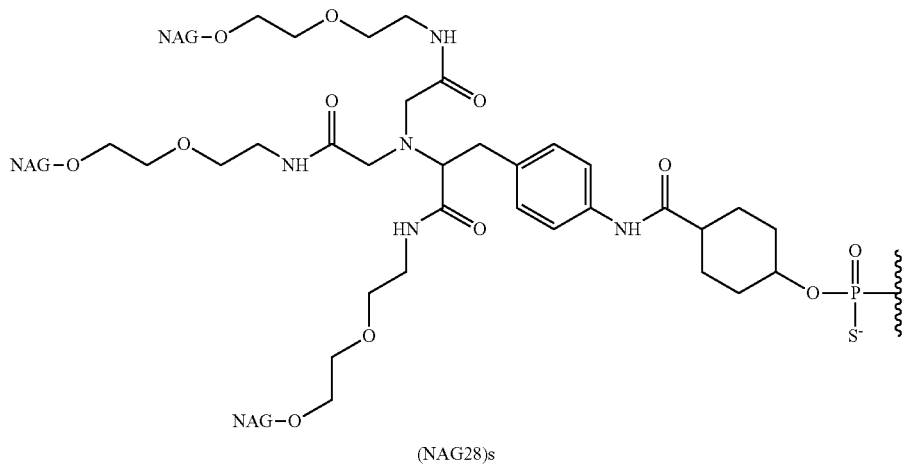
(NAG28)s
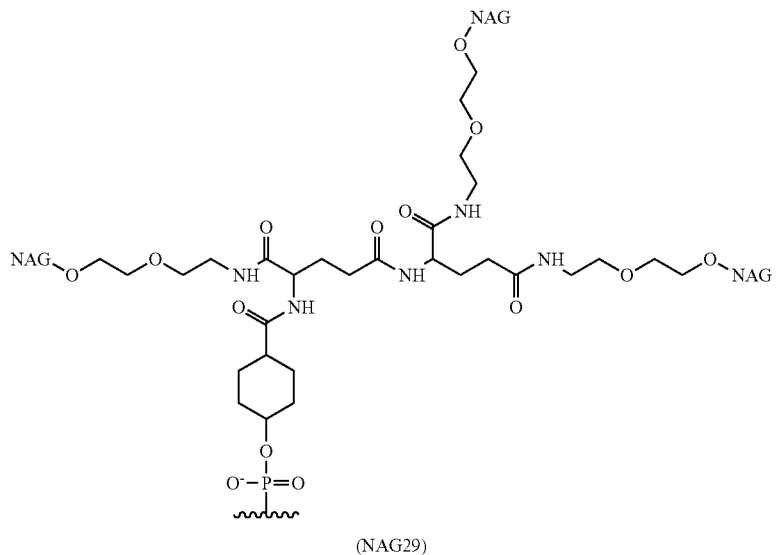
(NAG29)
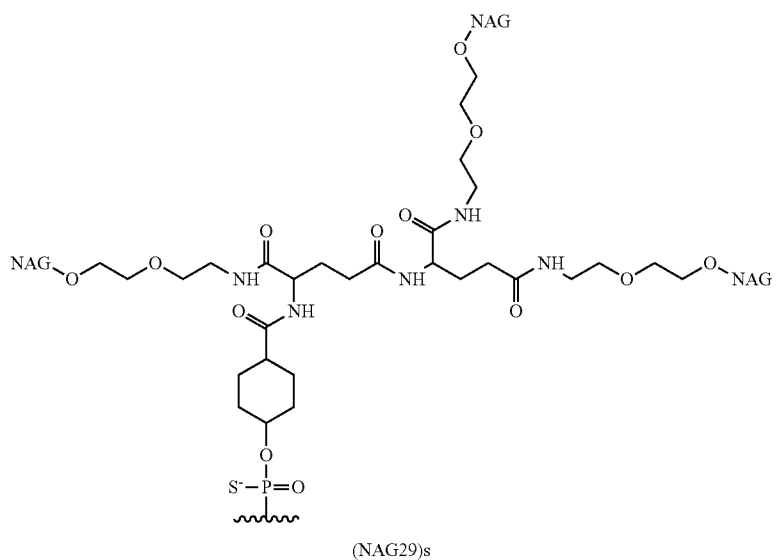
(NAG29)s TABLE 7-continued
Structure Representing Various Modified Nucleotides, Targeting Groups, and Linking Groups.
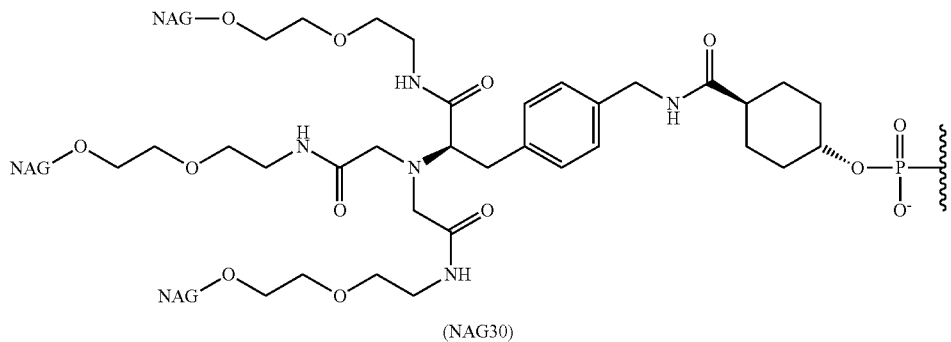
(NAG30)
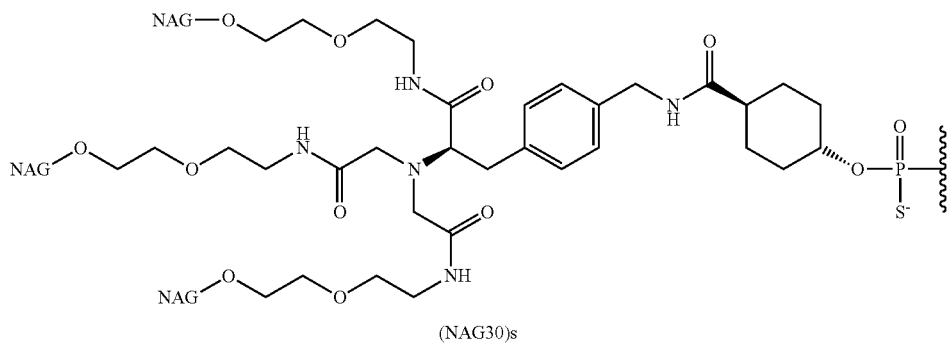
(NAG30)s
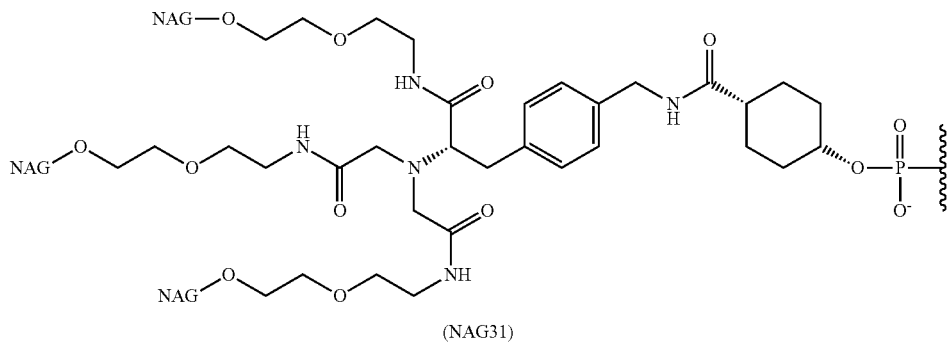
(NAG31)
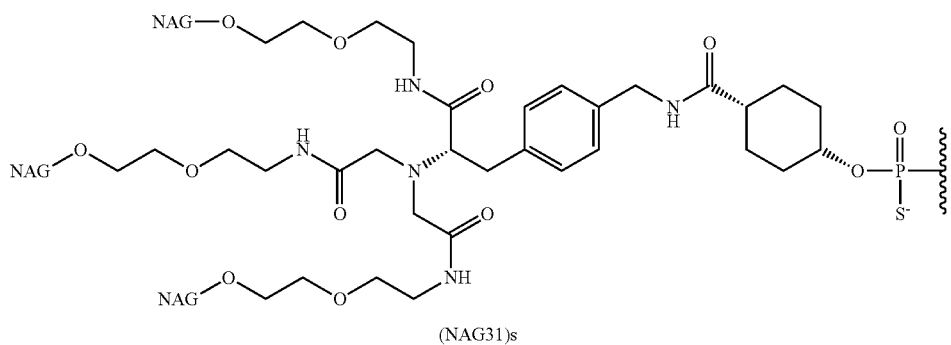
(NAG31)s TABLE 7-continued
Structure Representing Various Modified Nucleotides, Targeting Groups, and Linking Groups.
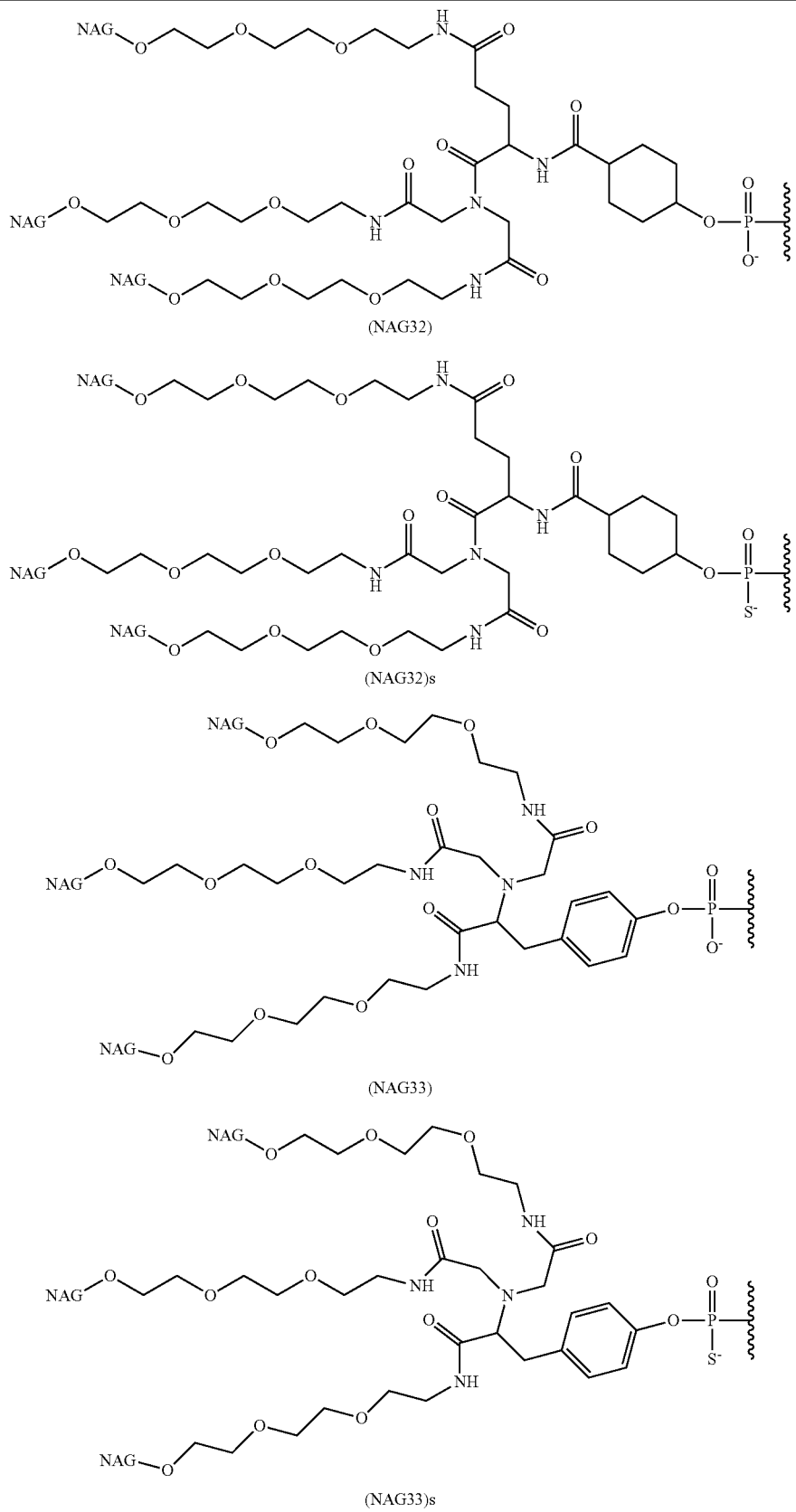
(NAG32)
(NAG32)s
(NAG33)
(NAG33)s TABLE 7-continued
Structure Representing Various Modified Nucleotides, Targeting Groups, and Linking Groups.
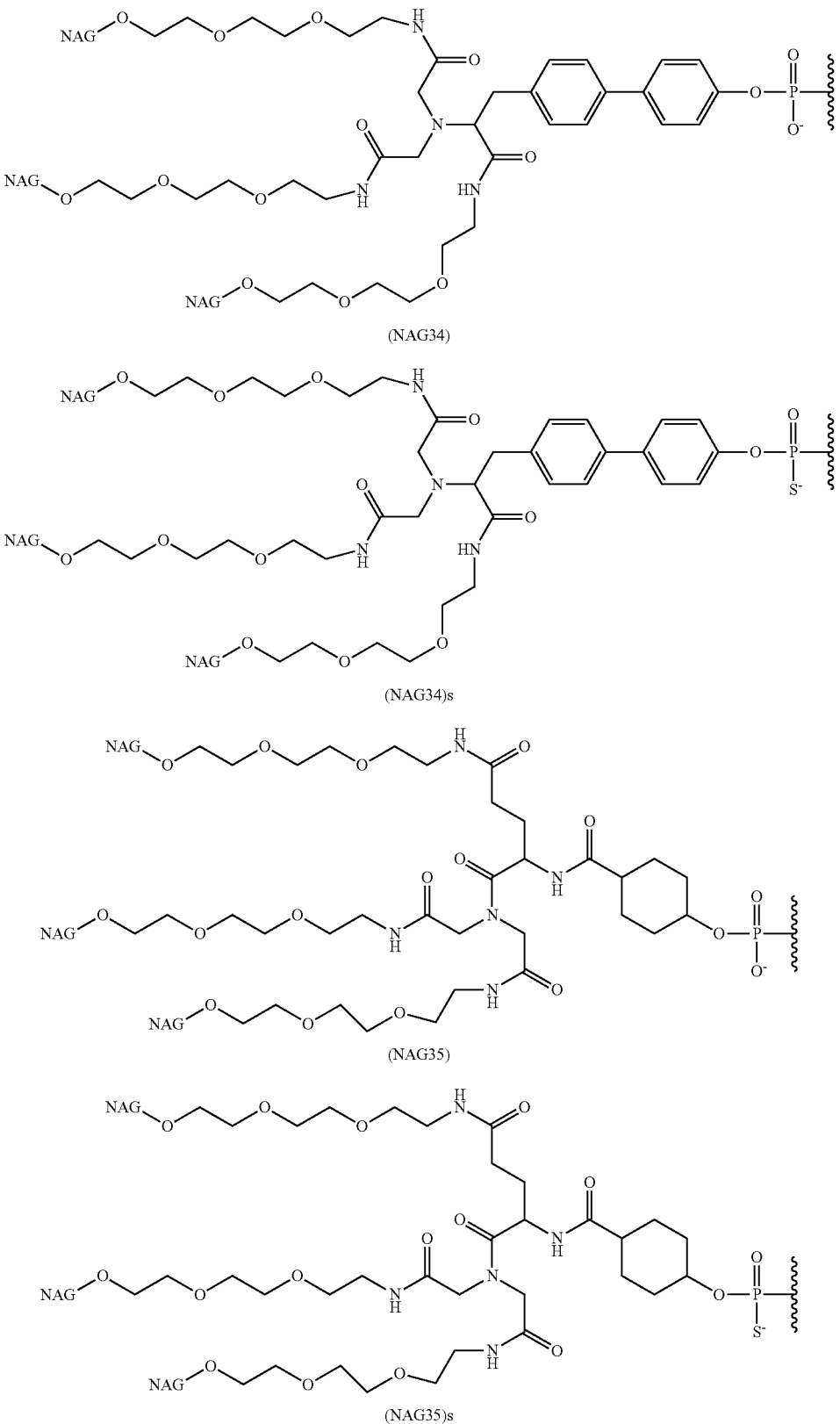
(NAG34)
(NAG34)s
(NAG35)
(NAG35)s TABLE 7-continued
Structure Representing Various Modified Nucleotides, Targeting Groups, and Linking Groups.
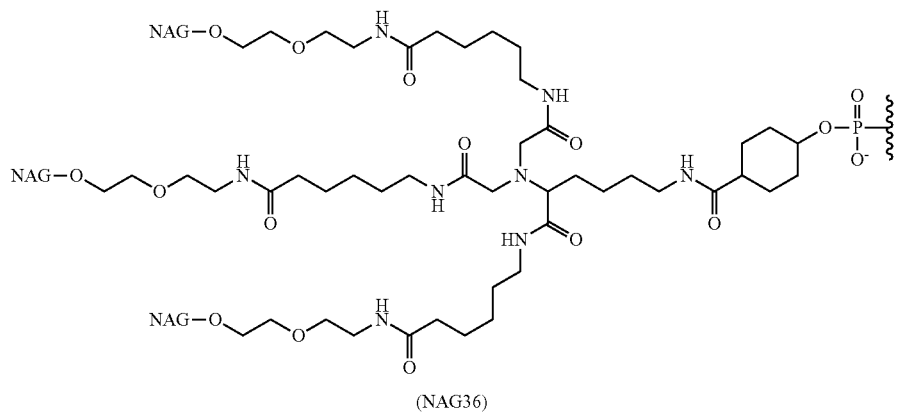
(NAG36)
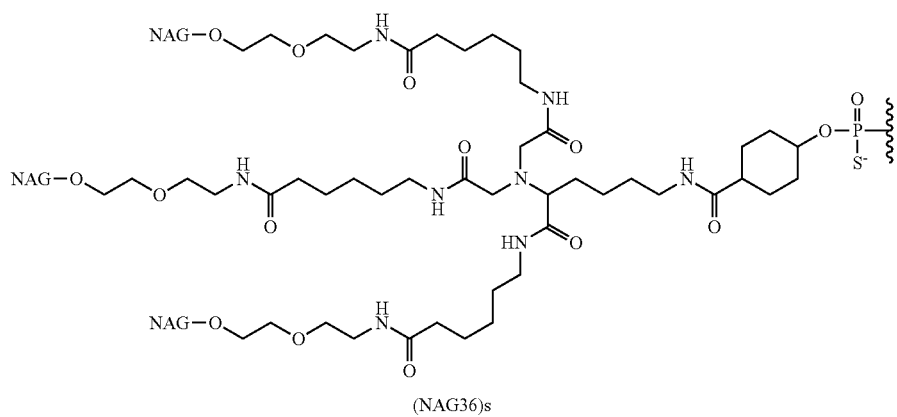
(NAG36)s
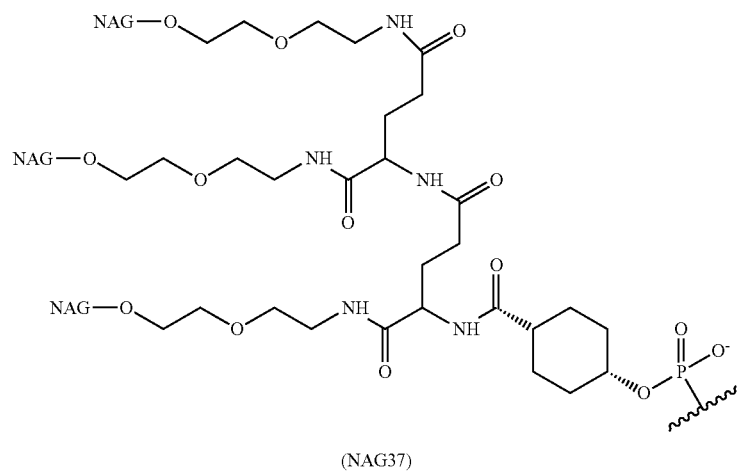
(NAG37)

TABLE 7-continued
Structure Representing Various Modified Nucleotides, Targeting Groups, and Linking Groups.
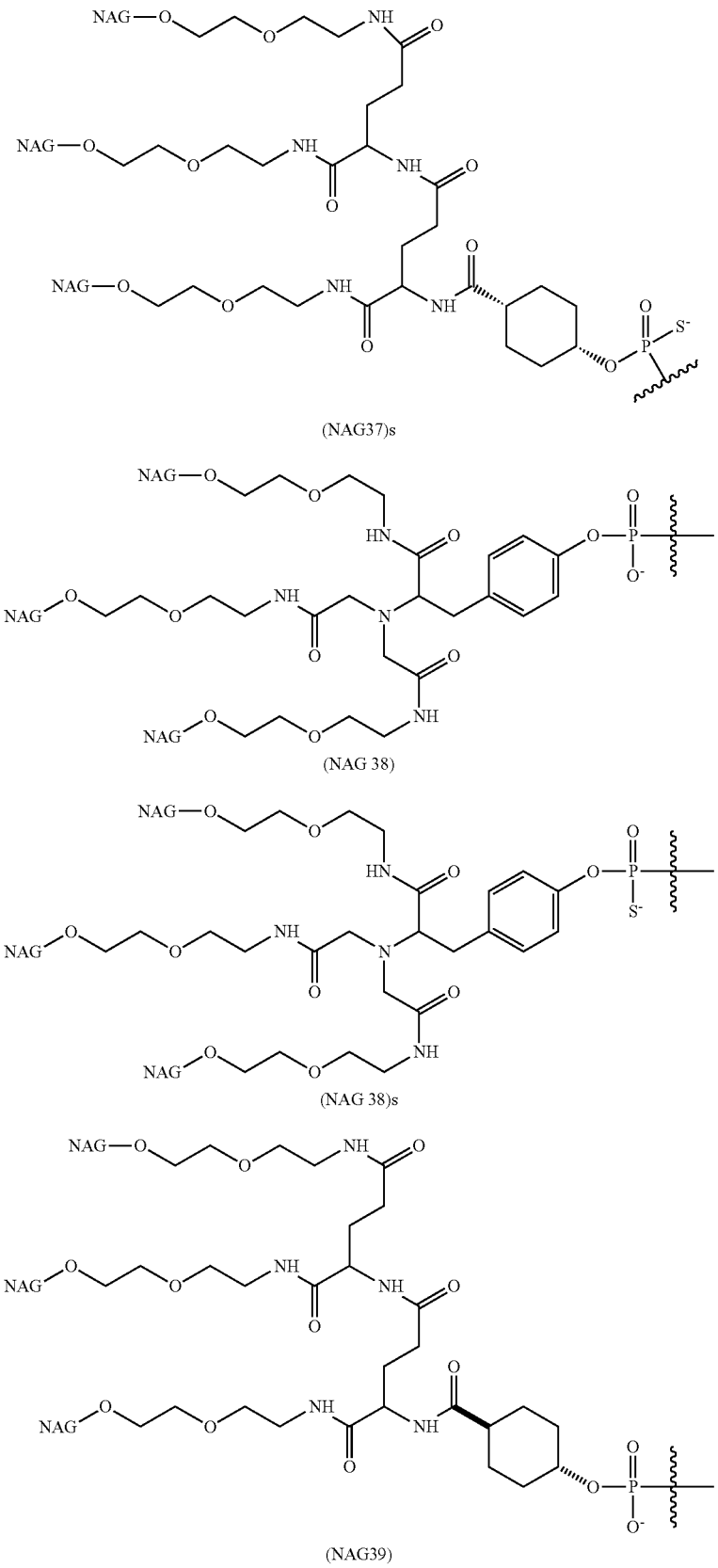
(NAG37)s
(NAG 38)
(NAG 38)s
(NAG39)

TABLE 7-continued

Structure Representing Various Modified Nucleotides, Targeting Groups, and Linking Groups.

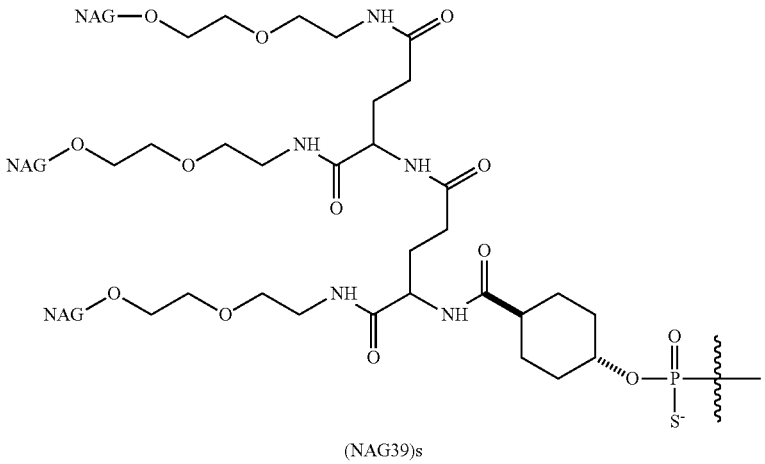

(NAG39)s

In each of the above structures in Table 7, NAG comprises an N-acetyl-galactosamine or another galactose derivative, as would be understood by a person of ordinary skill in the art to be attached in view of the structures above and description provided herein. For example, in some embodiments, NAG in the structures provided in Table 7 is represented by the following structure:

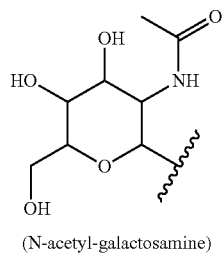 [SMILES: *C1OC(CO)C(O)C(O)C1NC(C)=O]

(N-acetyl-galactosamine)

Each (NAGx) may be attached to an APOC3 RNAi agent via a phosphate group (as in (NAG25), (NAG30), and (NAG31)), or a phosphorothioate group, (as is (NAG25)s, (NAG29)s, (NAG30)s, (NAG31)s, or (NAG37)s), or another linking group.

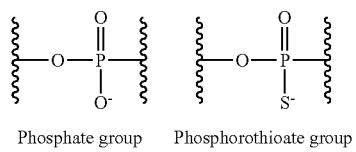

Phosphate group    Phosphorothioate group

Other linking groups known in the art may be used.

In some embodiments, a delivery vehicle can be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine. In some embodiments, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see, for example WO 2000/053722, WO 2008/0022309, WO 2011/104169, and WO 2012/083185, WO 2013/032829, WO 2013/158141, each of which is incorporated herein by reference), or other delivery systems available in the art.

Pharmaceutical Compositions and Formulations

The APOC3 RNAi agents disclosed herein can be prepared as pharmaceutical compositions or formulations. In some embodiments, pharmaceutical compositions include at least one APOC3 RNAi agent. These pharmaceutical compositions are particularly useful in the inhibition of the expression of the target mRNA in a target cell, a group of cells, a tissue, or an organism. The pharmaceutical compositions can be used to treat a subject having a disease or disorder that would benefit from reduction in the level of the target mRNA, or inhibition in expression of the target gene. The pharmaceutical compositions can be used to treat a subject at risk of developing a disease, disorder, or condition that would benefit from reduction of the level of the target mRNA or an inhibition in expression the target gene. In one embodiment, the method includes administering an APOC3 RNAi agent linked to a targeting ligand as described herein, to a subject to be treated. In some embodiments, one or more pharmaceutically acceptable excipients (including vehicles, carriers, diluents, and/or delivery polymers) are added to the pharmaceutical compositions including an APOC3 RNAi agent, thereby forming a pharmaceutical formulation suitable for in vivo delivery to a subject, including a human.

The pharmaceutical compositions that include an APOC3 RNAi agent and methods disclosed herein may decrease the level of the target mRNA in a cell, group of cells, group of cells, tissue, or subject, including: administering to the subject a therapeutically effective amount of a herein described APOC3 RNAi agent, thereby inhibiting the expression of APOC3 mRNA in the subject. In some embodiments, the subject has been previously identified as having a pathogenic upregulation of the target gene in the targeted cell or tissue.

In some embodiments, the described pharmaceutical compositions including an APOC3 RNAi agent are used for treating or managing clinical presentations associated with elevated TG levels and/or over-expression of APOC3 mRNA in a subject. In some embodiments, a therapeutically effective amount of one or more of pharmaceutical compositions is administered to a subject in need of such treatment (including the prevention or management of symptoms, diseases, or disorders). In some embodiments, administration of any of the disclosed APOC3 RNAi agents can be used to decrease the number, severity, and/or frequency of symptoms of a disease in a subject.

The described pharmaceutical compositions including an APOC3 RNAi agent can be used to treat at least one symptom in a subject having a disease or disorder that would benefit from reduction or inhibition in expression of APOC3 mRNA. In some embodiments, the subject is administered a therapeutically effective amount of one or more pharmaceutical compositions including an APOC3 RNAi agent thereby treating the symptom. In other embodiments, the subject is administered a prophylactically effective amount of one or more APOC3 RNAi agents, thereby preventing the at least one symptom.

The route of administration is the path by which an APOC3 RNAi agent is brought into contact with the body. In general, methods of administering drugs and oligonucleotides and nucleic acids for treatment of a mammal are well known in the art and can be applied to administration of the compositions described herein. The APOC3 RNAi agents disclosed herein can be administered via any suitable route in a preparation appropriately tailored to the particular route. Thus, herein described pharmaceutical compositions can be administered by injection, for example, intravenously, intramuscularly, intracutaneously, subcutaneously, intraarticularly, or intraperitoneally. In some embodiments, the herein described pharmaceutical compositions are administered via subcutaneous injection.

The pharmaceutical compositions including an APOC3 RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intramuscular, transdermal, airway (aerosol), nasal, oral, rectal, or topical (including buccal and sublingual) administration. In certain embodiments, the compositions are administered by subcutaneous or intravenous infusion or injection.

Accordingly, in some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., APOC3 RNAi agent) that are intentionally included in the drug delivery system. Excipients do not exert or are not intended to exert a therapeutic effect at the intended dosage. Excipients may act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, dextran, dextrose, diluents, disintegrants, emulsifiers, extenders, fillers, flavors, glidants, humectants, lubricants, oils, polymers, preservatives, saline, salts, solvents, sugars, suspending agents, sustained release matrices, sweeteners, thickening agents, tonicity agents, vehicles, water-repelling agents, and wetting agents.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor® ELTM (BASF, Parsippany, NJ) or phosphate buffered saline (PBS). Suitable carriers should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle, which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The APOC3 RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, analgesics, antihistamines, or anti-inflammatory agents (e.g., acetaminophen, NSAIDs, diphenhydramine, etc.). It is also envisioned that cells, tissues or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic or preventive result.

In some embodiments, the methods disclosed herein further comprise the step of administering a second therapeutic or treatment in addition to administering an RNAi agent disclosed herein. In some embodiments, the second therapeutic is another APOC3 RNAi agent (e.g., an APOC3 RNAi agent which targets a different sequence within the APOC3 target). In other embodiments, the second therapeutic can be a small molecule drug, an antibody, an antibody fragment, or an aptamer.

Generally, an effective amount of an active compound will be in the range of from about 0.1 to about 100 mg/kg of body weight/day, e.g., from about 1.0 to about 50 mg/kg of body weight/day. In some embodiments, an effective amount of an active compound will be in the range of from about 0.25 to about 5 mg/kg of body weight per dose. In some embodiments, an effective amount of an active ingredient will be in the range of from about 0.5 to about 4 mg/kg of body weight per dose. The amount administered will also likely depend on such variables as the overall health status of the patient, the relative biological efficacy of the compound delivered, the formulation of the drug, the presence and types of excipients in the formulation, and the route of administration. Also, it is to be understood that the initial dosage administered can, in some instances, be increased beyond the above upper level in order to rapidly achieve the desired blood-level or tissue level, or the initial dosage can, in some instances, be smaller than the optimum.

For treatment of disease or for formation of a medicament or composition for treatment of a disease, the pharmaceutical compositions described herein including an APOC3 RNAi agent can be combined with an excipient or with a second therapeutic agent or treatment including, but not limited to: a second or other RNAi agent, a small molecule drug, an antibody, an antibody fragment, peptide and/or a aptamer.

The described APOC3 RNAi agents, when added to pharmaceutically acceptable excipients or adjuvants, can be packaged into kits, containers, packs, or dispensers. The pharmaceutical compositions described herein may be packaged in pre-filled syringes or vials.

Methods of Treatment and Inhibition of Expression

The APOC3 RNAi agents disclosed herein can be used to treat a subject (e.g., a human or other mammal) having a disease or disorder that would benefit from administration of the compound. In some embodiments, the RNAi agents disclosed herein can be used to treat a subject (e.g., a human) having a disease or disorder that would benefit from a reduction and/or an inhibition in expression of APOC3 mRNA, for example, a subject that has been diagnosed with or is at risk of developing symptoms related to obesity, hyperlipidemia, hypertriglyceridemia, abnormal lipid and/or cholesterol metabolism, atherosclerosis, cardiovascular disease, coronary artery disease, hypertriglyceridemia mediated pancreatitis, metabolic syndrome, type II diabetes mellitus, familial chylomicronemia syndrome, familial partial lipodystrophy, and/or other metabolic-related disorders and diseases.

The subject is administered a therapeutically effective amount of any one or more RNAi agents. The subject can be a human, patient, or human patient. The subject may be an adult, adolescent, child, or infant. Administration of a pharmaceutical composition described herein can be to a human being or animal.

In some embodiments, the APOC3 RNAi agents described herein are used to treat a subject with an APOC3-related disease or disorder. In some embodiments, the APOC3 RNAi agents described herein are used to treat a subject that would benefit from a reduction and/or inhibition of APOC3 gene expression. In some embodiments, the described APOC3 RNAi agents are used to treat (including prophylactically) at least one symptom or pathological stated mediated at least in part by APOC3 gene expression. The subject is administered a therapeutically effective amount of any one or more of the described RNAi agents. In some embodiments, the subject is administered a prophylactically effective amount of any one or more of the described RNAi agents, thereby preventing the at least one symptom.

In certain embodiments, the present invention provides methods for treatment of diseases, disorders, conditions, or pathological states mediated at least in part by APOC3 expression, in a patient in need thereof, wherein the methods include administering to the patient any of the APOC3 RNAi agents described herein.

In some embodiments, the APOC3 RNAi agents are used to treat or manage a clinical presentation of a subject with an APOC3-related disease or disorder. The subject is administered a therapeutically effective amount of one or more of the APOC3 RNAi agents or APOC3 RNAi agent-containing compositions described herein. In some embodiments, the method comprises administering a composition comprising an APOC3 RNAi agent described herein to a subject to be treated.

In some embodiments, the gene expression level and/or mRNA level of an APOC3 gene in a subject to whom a described APOC3 RNAi agent is administered is reduced by at least about 30%, 35%, 40%, 45%, 50%, 55%, 60%, 65%, 70%, 75%, 80%, 85%, 95%, 96%, 97%, 98%, 99%, or greater than 99% relative to the subject prior to being administered the APOC3 RNAi agent or to a subject not receiving the APOC3 RNAi agent. The gene expression level and/or mRNA level in the subject is reduced in a cell, group of cells, and/or tissue of the subject.

In some embodiments, the protein level of APOC3 in a subject to whom a described APOC3 RNAi agent has been administered is reduced by at least about 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the APOC3 RNAi agent or to a subject not receiving the APOC3 RNAi agent. The protein level in the subject is reduced in a cell, group of cells, tissue, blood, and/or other fluid of the subject.

In some embodiments, the triglyceride (TG) levels in a subject to whom a described APOC3 RNAi agent has been administered is reduced by at least about 10%, 20%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the APOC3 RNAi agent or to a subject not receiving the APOC3 RNAi agent. The TG level in the subject may be reduced in a cell, group of cells, tissue, blood, and/or other fluid of the subject.

In some embodiments, the total cholesterol levels in a subject to whom a described APOC3 RNAi agent has been administered is reduced by at least about 10%, 20%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the APOC3 RNAi agent or to a subject not receiving the APOC3 RNAi agent. In some embodiments, the low-density lipoprotein (LDL) cholesterol levels in a subject to whom a described APOC3 RNAi agent has been administered is reduced by at least about 10%, 20%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the APOC3 RNAi agent or to a subject not receiving the APOC3 RNAi agent. The total cholesterol levels and/or LDL cholesterol levels in the subject may be reduced in a cell, group of cells, tissue, blood, and/or other fluid of the subject.

A reduction in gene expression, mRNA, APOC3 protein levels, TG levels, cholesterol levels, and LDL cholesterol levels can be assessed by any methods known in the art. As used herein, a reduction or decrease in APOC3 mRNA level and/or protein level are collectively referred to herein as a reduction or decrease in APOC3 or inhibiting or reducing or knocking down the expression of APOC3. The Examples set forth herein illustrate known methods for assessing inhibition of APOC3 gene expression.

Cells, Tissues, Organs, and Non-Human Organisms

Cells, tissues, organs, and non-human organisms that include at least one of the APOC3 RNAi agents described herein are contemplated. The cell, tissue, organ, or non-human organism is made by delivering the RNAi agent to the cell, tissue, organ, or non-human organism.

The above provided embodiments and items are now illustrated with the following, non-limiting examples.

EXAMPLES

Example 1. Synthesis of APOC3 RNAi Agents

APOC3 RNAi agent duplexes shown in Table 3 and Table 6, above, were synthesized in accordance with the following general procedures:
A. Synthesis. The sense and antisense strands of the APOC3 RNAi agents were synthesized according to phosphoramidite technology on solid phase used in oligonucleotide synthesis. Depending on the scale, either a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, PA, USA). All RNA and 2'-modified RNA phosphoramidites were purchased from Thermo Fisher Scientific (Milwaukee, WI, USA). Specifically, the following 2'-O-methyl phosphoramidites were used: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyanoethyl-N, N-diisopropylamino) phosphoramidite, and 5'-O-dimethoxytrityl-2'-O-methyl-uridine-3'-O-(2-cyanoethyl-N, N-diisopropylamino) phosphoramidite. The 2'-deoxy-2'-fluoro-phosphoramidites carried the same protecting groups as the 2'-O-methyl amidites. 5'-dimethoxytrityl-2'-O-methyl-inosine-3'-O-(2-cyanoethyl-N,N-diisopropylamino) phosphoramidites were purchased from Glen Research (Virginia) or Hongene Biotech. The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA). 5'-(4,4'-Dimethoxytrityl)-2',3'-seco-uridine, 2'-benzoyl-3'-[(2-cyanoethyl)-(N,N-diisopropyl)]-phosphoramidite was also purchased from Thermo Fisher Scientific or Hongene Biotech. The 5'-O-dimethoxytrityl-$N^2$,$N^6$-(phenoxyacetate)-2'-O-methyl-diaminopurine-3'-O-(2-cyanoethyl-N,N-diisopropylamino) phosphoramidite was obtained from ChemGenes or Hongene Biotech.

Targeting ligand containing phosphoramidites were dissolved in anhydrous dichloromethane or anhydrous acetonitrile (50 mM), while all other amidites were dissolved in anhydrous acetonitrile (50 mM), or anhydrous dimethylformamide and molecular sieves (3 Å) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 12 min (RNA), 15 min (targeting ligand), 90 sec (2'OMe), and 60 sec (2'F). In order to introduce phosphorothioate linkages, a 100 mM solution of 3-phenyl 1,2,4-dithiazoline-5-one (POS, obtained from PolyOrg, Inc., Leominster, MA, USA) in anhydrous Acetonitrile was employed. Unless specifically identified as a "naked" RNAi agent having no targeting ligand present, each of the APOC3 RNAi agent duplexes synthesized and tested in the following Examples utilized N-acetyl-galactosamine as "NAG" in the targeting ligand chemical structures represented in Table 7.

B. Cleavage and deprotection of support bound oligomer. After finalization of the solid phase synthesis, the dried solid support was treated with a 1:1 volume solution of 40 wt. %, methylamine in water and 28% ammonium hydroxide solution (Aldrich) for 1.5 hours at 30° C., The solution was evaporated and the solid residue was reconstituted in water (see below).

C. Purification. Crude oligomers were purified by anionic exchange HPLC using a TSKgel SuperQ-5PW 13 μm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 26/40 column packed with Sephadex G-25 fine with a running buffer of filtered DI water or 100 mM ammonium bicarbonate, pH 6.7 and 20% Acetonitrile.

D. Annealing. Complementary strands were mixed by combining equimolar RNA solutions (sense and antisense) in 1×Phosphate-Buffered Saline (Corning, Cellgro) to form the RNAi agents. Some RNAi agents were lyophilized and stored at −15 to −25° C. Duplex concentration was determined by measuring the solution absorbance on a UV-Vis spectrometer in 1×Phosphate-Buffered Saline. The solution absorbance at 260 nm was then multiplied by a conversion factor and the dilution factor to determine the duplex concentration. Unless otherwise stated, all conversion factor was 0.037 mg/(mL·cm). For some experiments, a conversion factor was calculated from an experimentally determined extinction coefficient.

Example 2. In Vitro Testing of APOC3 RNAi Agents

Candidate sequence duplexes shown in Table 3, above, were tested in vitro. The APOC3 RNAi agents were prepared in accordance with the procedures set forth in Example 1.

Evaluation of APOC3 RNAi agents in vitro was performed by transfection of HuH7 cells, a human hepatocellular carcinoma line. Cells were plated at 7,500 cells per well in 96-well format, and each of the 65 APOC3 RNAi agent duplexes shown in Table 3 was transfected at three concentrations (10 nM, 1 nM, and 0.1 nM), using LipoFectamine RNAiMax (Thermo Fisher) transfection reagent. Relative expression of each of the APOC3 RNAi agents was determined by qRT-PCR by comparing the expression levels of APOC3 mRNA to an endogenous control, and normalized to untreated HuH7 cells (AACT analysis), as shown in Table 8. Thus, for Duplex ID No. 56_1, average relative expression at 1 nM of 0.126 shows APOC3 gene knockdown of 87.4%.

TABLE 8

In Vitro Testing of APOC3 RNAi Agents.

| Duplex ID No. | Avg. Rel. Exp. 10 nM | High (error) | Low (error) | Avg. Rel. Exp. 1 nM | High (error) | Low (error) | Avg. Rel. Exp. 0.1 nM | High (error) | Low (error) |
|---|---|---|---|---|---|---|---|---|---|
| 56_1 | 0.081 | 0.013 | 0.016 | 0.126 | 0.033 | 0.045 | 0.249 | 0.083 | 0.125 |
| 56_2 | 0.076 | 0.014 | 0.017 | 0.116 | 0.027 | 0.035 | 0.190 | 0.060 | 0.088 |
| 56_3 | 0.084 | 0.016 | 0.020 | 0.124 | 0.028 | 0.036 | 0.313 | 0.114 | 0.179 |
| 56_4 | 0.098 | 0.023 | 0.031 | 0.155 | 0.045 | 0.063 | 0.534 | 0.122 | 0.157 |
| 56_5 | 0.100 | 0.026 | 0.034 | 0.138 | 0.029 | 0.036 | 0.511 | 0.161 | 0.236 |
| 58_1 | 0.130 | 0.028 | 0.035 | 0.237 | 0.021 | 0.023 | 0.713 | 0.177 | 0.235 |
| 58_2 | 0.118 | 0.018 | 0.021 | 0.319 | 0.039 | 0.045 | 0.602 | 0.058 | 0.064 |
| 58_3 | 0.070 | 0.011 | 0.013 | 0.152 | 0.018 | 0.020 | 0.383 | 0.025 | 0.026 |
| 58_4 | 0.069 | 0.012 | 0.015 | 0.168 | 0.022 | 0.025 | 0.453 | 0.031 | 0.034 |
| 58_5 | 0.062 | 0.009 | 0.011 | 0.189 | 0.047 | 0.062 | 0.557 | 0.045 | 0.049 |
| 228_1 | 0.055 | 0.011 | 0.014 | 0.377 | 0.039 | 0.043 | 0.684 | 0.043 | 0.046 |
| 228_2 | 0.096 | 0.011 | 0.013 | 0.472 | 0.040 | 0.043 | 0.720 | 0.074 | 0.083 |
| 228_3 | 0.143 | 0.023 | 0.027 | 0.525 | 0.021 | 0.022 | 0.804 | 0.035 | 0.036 |
| 228_4 | 0.115 | 0.018 | 0.022 | 0.518 | 0.036 | 0.038 | 0.740 | 0.029 | 0.030 |
| 228_5 | 0.165 | 0.029 | 0.035 | 0.547 | 0.040 | 0.043 | 0.721 | 0.036 | 0.038 |
| 235_1 | 0.142 | 0.025 | 0.030 | 0.566 | 0.045 | 0.049 | 0.737 | 0.035 | 0.036 |
| 235_2 | 0.064 | 0.013 | 0.016 | 0.370 | 0.030 | 0.033 | 0.713 | 0.042 | 0.045 |
| 235_3 | 0.029 | 0.008 | 0.011 | 0.085 | 0.015 | 0.018 | 0.535 | 0.048 | 0.053 |
| 235_4 | 0.050 | 0.010 | 0.012 | 0.197 | 0.018 | 0.019 | 0.652 | 0.045 | 0.048 |
| 235_5 | 0.079 | 0.019 | 0.025 | 0.328 | 0.043 | 0.050 | 0.719 | 0.113 | 0.134 |
| 243_1 | 0.044 | 0.012 | 0.017 | 0.222 | 0.046 | 0.058 | 0.671 | 0.114 | 0.137 |
| 243_2 | 0.035 | 0.008 | 0.011 | 0.358 | 0.041 | 0.047 | 0.701 | 0.068 | 0.076 |
| 243_3 | 0.022 | 0.007 | 0.009 | 0.142 | 0.033 | 0.042 | 0.567 | 0.070 | 0.080 |
| 243_4 | 0.016 | 0.007 | 0.013 | 0.115 | 0.018 | 0.021 | 0.502 | 0.073 | 0.086 |
| 243_5 | 0.039 | 0.011 | 0.016 | 0.123 | 0.019 | 0.022 | 0.597 | 0.050 | 0.055 |
| 260_1 | 0.021 | 0.007 | 0.011 | 0.390 | 0.062 | 0.074 | 0.719 | 0.034 | 0.035 |
| 260_2 | 0.042 | 0.008 | 0.010 | 0.728 | 0.062 | 0.068 | 0.719 | 0.042 | 0.045 |
| 260_3 | 0.026 | 0.008 | 0.012 | 0.747 | 0.067 | 0.073 | 0.685 | 0.044 | 0.047 |
| 260_4 | 0.021 | 0.009 | 0.015 | 0.507 | 0.064 | 0.073 | 0.749 | 0.064 | 0.070 |
| 260_5 | 0.057 | 0.014 | 0.019 | 0.572 | 0.040 | 0.043 | 0.745 | 0.051 | 0.054 |
| 261_1 | 0.046 | 0.007 | 0.008 | 0.295 | 0.039 | 0.045 | 0.766 | 0.044 | 0.046 |
| 261_2 | 0.052 | 0.017 | 0.024 | 0.611 | 0.037 | 0.039 | 0.823 | 0.050 | 0.053 |
| 261_3 | 0.032 | 0.007 | 0.009 | 0.303 | 0.025 | 0.028 | 0.727 | 0.024 | 0.025 |
| 261_4 | 0.027 | 0.005 | 0.007 | 0.756 | 0.031 | 0.032 | 0.690 | 0.032 | 0.033 |
| 261_5 | 0.041 | 0.005 | 0.006 | 0.868 | 0.099 | 0.112 | 0.737 | 0.031 | 0.032 |
| 270_1 | 0.031 | 0.006 | 0.008 | 0.294 | 0.052 | 0.063 | 0.719 | 0.046 | 0.049 |
| 270_2 | 0.055 | 0.015 | 0.020 | 0.344 | 0.066 | 0.082 | 0.738 | 0.036 | 0.038 |
| 270_3 | 0.047 | 0.014 | 0.019 | 0.359 | 0.019 | 0.020 | 0.811 | 0.028 | 0.029 |
| 270_4 | 0.023 | 0.005 | 0.006 | 0.212 | 0.019 | 0.021 | 0.706 | 0.034 | 0.035 |
| 270_5 | 0.027 | 0.007 | 0.010 | 0.615 | 0.030 | 0.032 | 0.685 | 0.036 | 0.038 |
| 272_1 | 0.046 | 0.011 | 0.015 | 0.398 | 0.024 | 0.025 | 0.696 | 0.015 | 0.015 |
| 272_2 | 0.057 | 0.012 | 0.015 | 0.343 | 0.030 | 0.033 | 0.719 | 0.059 | 0.064 |
| 272_3 | 0.071 | 0.010 | 0.012 | 0.269 | 0.034 | 0.039 | 0.736 | 0.034 | 0.036 |
| 272_4 | 0.061 | 0.018 | 0.026 | 0.135 | 0.016 | 0.018 | 0.747 | 0.041 | 0.044 |
| 272_5 | 0.089 | 0.023 | 0.031 | 0.322 | 0.025 | 0.027 | 0.793 | 0.029 | 0.030 |
| 273_1 | 0.014 | 0.004 | 0.006 | 0.066 | 0.019 | 0.026 | 0.665 | 0.043 | 0.046 |
| 273_2 | 0.016 | 0.004 | 0.005 | 0.064 | 0.012 | 0.015 | 0.676 | 0.040 | 0.042 |
| 273_3 | 0.012 | 0.003 | 0.005 | 0.041 | 0.007 | 0.008 | 0.606 | 0.041 | 0.044 |
| 273_4 | 0.016 | 0.003 | 0.004 | 0.060 | 0.009 | 0.011 | 0.687 | 0.036 | 0.038 |
| 273_5 | 0.024 | 0.004 | 0.004 | 0.101 | 0.008 | 0.009 | 0.736 | 0.055 | 0.059 |

TABLE 8-continued

In Vitro Testing of APOC3 RNAi Agents.

| Duplex ID No. | Avg. Rel. Exp. 10 nM | High (error) | Low (error) | Avg. Rel. Exp. 1 nM | High (error) | Low (error) | Avg. Rel. Exp. 0.1 nM | High (error) | Low (error) |
|---|---|---|---|---|---|---|---|---|---|
| 349_1 | 0.044 | 0.007 | 0.009 | 0.196 | 0.017 | 0.018 | 0.711 | 0.091 | 0.104 |
| 349_2 | 0.054 | 0.017 | 0.025 | 0.226 | 0.015 | 0.016 | 0.820 | 0.058 | 0.063 |
| 349_3 | 0.031 | 0.012 | 0.020 | 0.157 | 0.019 | 0.021 | 0.761 | 0.073 | 0.081 |
| 349_4 | 0.033 | 0.013 | 0.022 | 0.148 | 0.015 | 0.017 | 0.810 | 0.096 | 0.108 |
| 349_5 | 0.043 | 0.016 | 0.024 | 0.214 | 0.013 | 0.014 | 0.853 | 0.077 | 0.084 |
| 434_1 | 0.074 | 0.008 | 0.009 | 0.147 | 0.019 | 0.021 | 0.860 | 0.044 | 0.047 |
| 434_2 | 0.031 | 0.004 | 0.005 | 0.055 | 0.012 | 0.016 | 0.390 | 0.080 | 0.101 |
| 434_3 | 0.026 | 0.003 | 0.004 | 0.053 | 0.011 | 0.015 | 0.418 | 0.015 | 0.016 |
| 434_4 | 0.020 | 0.004 | 0.005 | 0.085 | 0.023 | 0.032 | 0.488 | 0.018 | 0.019 |
| 434_5 | 0.024 | 0.002 | 0.002 | 0.096 | 0.024 | 0.032 | 0.661 | 0.039 | 0.042 |
| 437_1 | 0.028 | 0.005 | 0.006 | 0.073 | 0.022 | 0.031 | 0.689 | 0.033 | 0.034 |
| 437_2 | 0.046 | 0.006 | 0.006 | 0.150 | 0.037 | 0.049 | 0.798 | 0.030 | 0.031 |
| 437_3 | 0.044 | 0.005 | 0.005 | 0.043 | 0.006 | 0.007 | 0.591 | 0.023 | 0.024 |
| 437_4 | 0.023 | 0.004 | 0.006 | 0.030 | 0.005 | 0.006 | 0.759 | 0.033 | 0.035 |
| 437_5 | 0.024 | 0.002 | 0.003 | 0.061 | 0.006 | 0.006 | 0.750 | 0.048 | 0.051 |

Example 3. APOC3-SEAP Mouse Model

Six to eight week old female C57BL/6 albino mice were transiently transfected in vivo with plasmid by hydrodynamic tail vein injection, administered at least 15 days prior to administration of an APOC3 RNAi agent or control. The plasmid contains the APOC3 cDNA sequence (GenBank NM_000040.1 (SEQ ID NO:1)) inserted into the 3' UTR of the SEAP (secreted human placental alkaline phosphatase) reporter gene. 50 μg of the plasmid containing the APOC3 cDNA sequence in Ringer's Solution in a total volume of 10% of the animal's body weight was injected into mice via the tail vein to create APOC3-SEAP model mice. The solution was injected through a 27-gauge needle in 5-7 seconds as previously described (Zhang G et al., "High levels of foreign gene expression in hepatocytes after tail vein injection of naked plasmid DNA." Human Gene Therapy 1999 Vol. 10, p 1735-1737). Inhibition of expression of APOC3 by an APOC3 RNAi agent results in concomitant inhibition of SEAP expression, which is measured. At day −1, SEAP expression levels in serum were measured by the Phospha-Light™ SEAP Reporter Gene Assay System (Invitrogen), and the mice were grouped according to average SEAP levels.

Analyses: SEAP levels may be measured at various times, both before and after administration of APOC3 RNAi agents.
  i) Serum collection: Mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C.
  ii) Serum SEAP levels: Serum was collected and measured by the Phospha-Light™ SEAP Reporter Gene Assay System (Invitrogen) according to the manufacturer's instructions. Serum SEAP levels for each animal was normalized to the control group of mice injected with saline in order to account for the non-treatment related decline in APOC3 expression with this model. First, the SEAP level for each animal at a time point was divided by the pre-treatment level of expression in that animal (Day −1) in order to determine the ratio of expression "normalized to pre-treatment". Expression at a specific time point was then normalized to the control group by dividing the "normalized to pre-treatment" ratio for an individual animal by the average "normalized to pre-treatment" ratio of all mice in the normal saline control group. Alternatively, in some Examples set forth herein, the serum SEAP levels for each animal were assessed by normalizing to pre-treatment levels only.

Example 4. In Vivo Testing of APOC3 RNAi Agents in APOC3-SEAP Mice

The APOC3-SEAP mouse model described in Example 3, above, was used. At day 1, each mouse was given a single subcutaneous administration of 200 μl containing either 5 mg/kg (mpk) of an APOC3 RNAi agent, 3 mg/kg of an APOC3 RNAi agent, or 200 μl of phosphate buffered saline without an APOC3 RNAi agent to be used as a control, according to the following Table 9.

TABLE 9

Dosing groups of APOC3-SEAP mice of Example 4.

| Group | RNAi Agent and Dose | Dosing Regimen |
|---|---|---|
| A | Saline (no RNAi agent) | Single injection on day 1 |
| B | 5.0 mg/kg AD04812 | Single injection on day 1 |
| C | 5.0 mg/kg AD04813 | Single injection on day 1 |
| D | 5.0 mg/kg AD04814 | Single injection on day 1 |
| E | 3.0 mg/kg AD04814 | Single injection on day 1 |
| F | 5.0 mg/kg AD04815 | Single injection on day 1 |
| G | 5.0 mg/kg AD04816 | Single injection on day 1 |
| H | 3.0 mg/kg AD04816 | Single injection on day 1 |
| I | 5.0 mg/kg AD04817 | Single injection on day 1 |
| J | 5.0 mg/kg AD04818 | Single injection on day 1 |
| K | 5.0 mg/kg AD04819 | Single injection on day 1 |
| L | 5.0 mg/kg AD04820 | Single injection on day 1 |
| M | 5.0 mg/kg AD04821 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 4, 5, 6, and 7 for specific modifications and structure information related to the APOC3 RNAi agents).

The injections were performed between the skin and muscle (i.e. subcutaneous injections) into the loose skin over the neck and shoulder area. Three (3) mice in each group were tested (n=3). Serum was collected on day 8, day 15, day 22, and day 29, and SEAP expression levels were determined pursuant to the procedure set forth in Example 3, above. Data from the experiment is shown in the following Table 10, with Average SEAP reflecting the normalized average value of SEAP:

TABLE 10

Average SEAP Normalized to Pre-Treatment and Saline Control in APOC3-SEAP Mice from Example 4.

| Group ID | Day 8 Avg SEAP | Day 8 Std Dev (+/−) | Day 15 Avg SEAP | Day 15 Std Dev (+/−) | Day 22 Avg SEAP | Day 22 Std Dev (+/−) | Day 29 Avg SEAP | Day 29 Std Dev (+/−) |
|---|---|---|---|---|---|---|---|---|
| Group A (Saline) | 1.000 | 0.157 | 1.000 | 0.603 | 1.000 | 0.864 | 1.000 | 0.701 |
| Group B (5.0 mg/kg AD04812) | 0.112 | 0.009 | 0.112 | 0.009 | 0.047 | 0.014 | 0.089 | 0.032 |
| Group C (5.0 mg/kg AD04813) | 0.091 | 0.009 | 0.046 | 0.015 | 0.052 | 0.019 | 0.102 | 0.045 |
| Group D (5.0 mg/kg AD04814) | 0.065 | 0.023 | 0.045 | 0.016 | 0.039 | 0.017 | 0.073 | 0.027 |
| Group E (3.0 mg/kg AD04814) | 0.075 | 0.021 | 0.041 | 0.037 | 0.047 | 0.046 | 0.059 | 0.053 |
| Group F (5.0 mg/kg AD04815) | 0.090 | 0.005 | 0.032 | 0.015 | 0.026 | 0.012 | 0.046 | 0.018 |
| Group G (5.0 mg/kg AD04816) | 0.401 | 0.122 | 0.399 | 0.136 | 0.274 | 0.053 | 0.331 | 0.094 |
| Group H (3.0 mg/kg AD04816) | 0.389 | 0.129 | 0.292 | 0.090 | 0.218 | 0.070 | 0.185 | 0.039 |
| Group I (5.0 mg/kg AD04817) | 0.371 | 0.210 | 0.266 | 0.091 | 0.098 | 0.014 | 0.144 | 0.033 |
| Group J (5.0 mg/kg AD04818) | 0.373 | 0.028 | 0.467 | 0.190 | 0.218 | 0.153 | 0.323 | 0.232 |
| Group K (5.0 mg/kg AD04819) | 0.216 | 0.123 | 0.334 | 0.034 | 0.407 | 0.053 | 0.408 | 0.042 |
| Group L (5.0 mg/kg AD04820) | 0.164 | 0.085 | 0.226 | 0.206 | 0.219 | 0.165 | 0.252 | 0.157 |
| Group M (5.0 mg/kg AD04821) | 0.169 | 0.097 | 0.128 | 0.061 | 0.150 | 0.105 | 0.191 | 0.143 |

Each of the APOC3 RNAi agents in each of the dosing groups (i.e., Groups B through M) showed substantial reduction in SEAP as compared to the saline control (Group A) across all measured time points. For example, APOC3 RNAi agent AD04815 exhibited approximately a 97.4% reduction in SEAP at day 22 after a single 5.0 mg/kg injection (0.026).

Example 5. APOC3 Transgenic Mouse Model

To assess and evaluate the effect of certain other APOC3 RNAi agents in vivo, APOC3 transgenic mice were acquired commercially and used (The Jackson Laboratory, 006907-B6; CBA-Tg(APOC3)3707Bres/J). For APOC3 transgenic mice, human APOC3 protein levels in serum were measured on a Cobas® Integra 400 (Roche Diagnostics), according to the manufacturer's recommendations.

For normalization, the APOC3 level for each animal at a time point was divided by the pre-treatment level of expression in that animal to determine the ratio of expression "normalized to pre-dose". In some Examples reported herein, the expression at a specific time point was also then normalized to the vehicle control group by dividing the "normalized to pre-dose" ratio for an individual animal by the mean "normalized to pre-dose" ratio of all mice in the vehicle control group. This resulted in expression for each time point normalized to that in the control group.

APOC3 levels may be measured at various times, both before and after administration of APOC3 RNAi agents. Unless noted otherwise herein, mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C.

Example 6. In Vivo Testing of APOC3 RNAi Agents in APOC3 Transgenic Mice

The APOC3 Transgenic Mouse Model described in Example 5, above, was used. At day 1, each mouse was given a single subcutaneous administration of 200 µl of the respective RNAi agent dissolved in D5W (dextrose in 5% water) or control (D5W), which included the dosing groups shown in the following Table 11.

TABLE 11

Dosing Groups of APOC3 Transgenic Mice of Example 6.

| Group | RNAi Agent and Dose | Dosing Regimen |
|---|---|---|
| A | D5W (no RNAi agent) | Single injection on day 1 |
| B | 4.0 mg/kg AD05172 | Single injection on day 1 |
| C | 2.0 mg/kg AD05172 | Single injection on day 1 |
| D | 1.0 mg/kg AD05172 | Single injection on day 1 |
| E | 0.5 mg/kg AD05172 | Single injection on day 1 |
| F | 1.0 mg/kg AD05215 | Single injection on day 1 |
| G | 1.0 mg/kg AD05216 | Single injection on day 1 |
| H | 1.0 mg/kg AD05217 | Single injection on day 1 |
| I | 1.0 mg/kg AD05218 | Single injection on day 1 |
| J | 1.0 mg/kg AD05171 | Single injection on day 1 |
| K | 2.0 mg/kg AD05219 | Single injection on day 1 |
| L | 2.0 mg/kg AD05222 | Single injection on day 1 |
| M | 2.0 mg/kg AD05221 | Single injection on day 1 |
| N | 2.0 mg/kg AD05223 | Single injection on day 1 |

Each of the APOC3 RNAi agents was conjugated to a targeting ligand that included three N-acetyl-galactosamines (i.e., a tridentate NAG ligand), having the modified sequences and NAG structures as set forth herein. (See Tables 4, 5, 6, and 7 for specific modifications and structure information for the APOC3 RNAi agents used in Example 6).

The injections were performed between the skin and muscle (i.e. subcutaneous injections) into the loose skin over the neck and shoulder area. Three (3) mice in each group were tested (n=3). Serum was collected from the mice, including on day −1 (pre-dose bleed with a four hour fast), and days 8, 15, 22, and 29. Mice were fasted for four hours prior to each collection. APOC3 expression levels were determined pursuant to the procedure set forth in Example 5, above. Data are shown in the following Table 12, with Average APOC3 reflecting the normalized average value of APOC3 protein expressed in serum:

TABLE 12

Average APOC3 Protein Normalized to Pre-Treatment and Vehicle Control (D5W) in APOC3 Transgenic Mice from Example 6.

| | Day 8 | | Day 15 | | Day 22 | | Day 29 | |
|---|---|---|---|---|---|---|---|---|
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group A (D5W) | 1.000 | 0.038 | 1.000 | 0.177 | 1.000 | 0.154 | 1.000 | 0.152 |
| Group B (4.0 mg/kg AD05172) | 0.074 | 0.018 | 0.067 | 0.018 | 0.083 | 0.008 | 0.105 | 0.019 |
| Group C (2.0 mg/kg AD05172) | 0.094 | 0.022 | 0.084 | 0.017 | 0.101 | 0.013 | 0.126 | 0.029 |
| Group D (1.0 mg/kg AD05172) | 0.113 | 0.039 | 0.115 | 0.038 | 0.150 | 0.050 | 0.212 | 0.095 |
| Group E (0.5 mg/kg AD05172) | 0.153 | 0.050 | 0.191 | 0.087 | 0.245 | 0.102 | 0.461 | 0.169 |
| Group F (1.0 mg/kg AD05215) | 0.114 | 0.003 | 0.124 | 0.016 | 0.173 | 0.037 | 0.550 | 0.119 |
| Group G (1.0 mg/kg AD05216) | 0.148 | 0.042 | 0.136 | 0.016 | 0.185 | 0.031 | 0.342 | 0.034 |
| Group H (1.0 mg/kg AD05217) | 0.161 | 0.020 | 0.179 | 0.025 | 0.241 | 0.048 | 0.464 | 0.306 |
| Group I (1.0 mg/kg AD05218) | 0.168 | 0.064 | 0.210 | 0.127 | 0.517 | 0.248 | 0.779 | 0.418 |
| Group J (1.0 mg/kg AD05171) | 0.125 | 0.039 | 0.126 | 0.043 | 0.165 | 0.050 | 0.302 | 0.117 |
| Group K (2.0 mg/kg AD05219) | 0.091 | 0.044 | 0.070 | 0.018 | 0.084 | 0.025 | 0.095 | 0.034 |
| Group L (2.0 mg/kg AD05222) | 0.130 | 0.054 | 0.230 | 0.114 | 0.265 | 0.147 | 0.484 | 0.047 |
| Group M (2.0 mg/kg AD05221) | 0.131 | 0.026 | 0.148 | 0.041 | 0.289 | 0.126 | 0.410 | 0.098 |
| Group N (2.0 mg/kg AD05223) | 0.082 | 0.047 | 0.062 | 0.019 | 0.073 | 0.021 | 0.080 | 0.022 |

Each of the APOC3 RNAi agents in each of the dosing groups (i.e., Groups B through M) showed a reduction in APOC3 as compared to the control (Group A) across the measured time points. For example, after a single 2.0 mg/kg dose on day 1, APOC3 RNAi agent AD05223 showed an approximately 94% reduction (0.062) at day 15.

Example 7. In Vivo Testing of APOC3 RNAi Agents in APOC3 Transgenic Mice

The APOC3 Transgenic Mouse Model described in Example 5, above, was used. At day 1, each mouse was given a single subcutaneous administration of 200 µl of the respective RNAi agent dissolved in D5W (dextrose in 5% water) or control (D5W) according to the dosing groups shown in the following Table 13.

TABLE 13

Dosing Groups of APOC3 Transgenic Mice of Example 7.

| Group | RNAi Agent and Dose | Dosing Regimen |
|---|---|---|
| 1 | D5W (no RNAi agent) | Single injection on day 1 |
| 2 | 1.0 mg/kg AD05172 | Single injection on day 1 |
| 3 | 1.0 mg/kg AD05255 | Single injection on day 1 |
| 4 | 1.0 mg/kg AD05169 | Single injection on day 1 |
| 5 | 1.0 mg/kg AD05249 | Single injection on day 1 |
| 6 | 1.0 mg/kg AD05250 | Single injection on day 1 |
| 7 | 1.0 mg/kg AD05251 | Single injection on day 1 |

TABLE 13-continued

Dosing Groups of APOC3 Transgenic Mice of Example 7.

| Group | RNAi Agent and Dose | Dosing Regimen |
|---|---|---|
| 8 | 1.0 mg/kg AD05252 | Single injection on day 1 |
| 9 | 1.0 mg/kg AD05253 | Single injection on day 1 |
| 10 | 1.0 mg/kg AD05254 | Single injection on day 1 |
| 11 | 1.0 mg/kg AD05220 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 4, 5, 6, and 7 for specific modifications and structure information related to the APOC3 RNAi agents).

The injections were performed between the skin and muscle (i.e. subcutaneous injections) into the loose skin over the neck and shoulder area. Three (3) mice in each group were tested (n=3). Serum was collected from the mice, including on day −1 (pre-dose bleed with a four hour fast), and days 8, 15, 22, and 29. Mice were fasted for four hours prior to each collection. APOC3 expression levels were determined pursuant to the procedure set forth in Example 5, above. Data from day 8 of the experiment are shown in the following Table 14, with Average APOC3 reflecting the normalized average value of APOC3 protein expressed in serum:

TABLE 14

Average APOC3 Protein Normalized to Pre-Treatment and Vehicle Control (D5W) in APOC3 Transgenic Mice from Example 7.

| | Day 8 | | Day 15 | | Day 22 | | Day 29 | |
|---|---|---|---|---|---|---|---|---|
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group 1 (D5W) | 1.000 | 0.092 | 1.000 | 0.096 | 1.000 | 0.089 | 1.000 | 0.103 |
| Group 2 (1.0 mg/kg AD05172) | 0.125 | 0.033 | 0.133 | 0.040 | 0.175 | 0.050 | 0.198 | 0.061 |
| Group 3 (1.0 mg/kg AD05255) | N/A* | N/A* | 0.279 | 0.394 | 0.969 | 0.050 | 1.103 | 0.216 |
| Group 4 (1.0 mg/kg AD05169) | 0.179 | 0.056 | 0.185 | 0.067 | 0.206 | 0.058 | 0.245 | 0.084 |
| Group 5 (1.0 mg/kg AD05249) | 0.212 | 0.045 | 0.263 | 0.055 | 0.460 | 0.083 | 0.863 | 0.586 |
| Group 6 (1.0 mg/kg AD05250) | 0.167 | 0.070 | 0.146 | 0.048 | 0.169 | 0.062 | 0.203 | 0.051 |
| Group 7 (1.0 mg/kg AD05251) | 0.140 | 0.071 | 0.121 | 0.077 | 0.170 | 0.094 | 0.181 | 0.103 |
| Group 8 (1.0 mg/kg AD05252) | 0.143 | 0.045 | 0.167 | 0.050 | 0.184 | 0.048 | 0.296 | 0.088 |

TABLE 14-continued

Average APOC3 Protein Normalized to Pre-Treatment and Vehicle Control (D5W) in APOC3 Transgenic Mice from Example 7.

|  | Day 8 | | Day 15 | | Day 22 | | Day 29 | |
| --- | --- | --- | --- | --- | --- | --- | --- | --- |
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group 9 (1.0 mg/kg AD05253) | 0.192 | 0.068 | 0.202 | 0.063 | 0.238 | 0.096 | 0.473 | 0.220 |
| Group 10 (1.0 mg/kg AD05254) | 0.184 | 0.075 | 0.225 | 0.075 | 0.296 | 0.124 | 0.294 | 0.137 |
| Group 11 (1.0 mg/kg AD05220) | 0.089 | 0.012 | 0.109 | 0.014 | 0.107 | 0.018 | 0.118 | 0.027 |

*samples for Group 3, Day 8 were lost due to equipment failure

Each of the APOC3 RNAi agents in each of the dosing groups (i.e., Groups 2 through 11) showed a reduction in APOC3 protein levels as compared to the control (Group 1) at days 8 and 15. In particular, APOC3 RNAi agents AD05251 and AD05169 (each having an antisense strand sequence designed to target position 438 of an APOC3 gene (i.e., SEQ ID NO:1), as well as APOC3 RNA agent AD05220 (having an antisense strand sequence designed to target position 506 of an APOC3 gene), showed particularly potent inhibitory effect. (See, e.g., Groups 4, 7, and 11 in Table 14, above).

Example 8. In Vivo Testing of APOC3 RNAi Agents in APOC3 Transgenic Mice

The APOC3 Transgenic Mouse Model described in Example 5, above, was used. At day 1, each mouse was given a single subcutaneous administration of 200 µl of the respective RNAi agent dissolved in D5W (dextrose in 5% water) or control (D5W) according to the dosing groups shown in the following Table 13.

TABLE 15

Dosing groups of Example 8.

| Group | RNAi Agent and Dose | Dosing Regimen |
| --- | --- | --- |
| 1 | D5W (no RNAi agent) | Single injection on day 1 |
| 2 | 0.5 mg/kg AD05540 | Single injection on day 1 |
| 3 | 0.5 mg/kg AD05283 | Single injection on day 1 |
| 4 | 0.5 mg/kg AD05705 | Single injection on day 1 |
| 5 | 0.5 mg/kg AD05706 | Single injection on day 1 |
| 6 | 0.5 mg/kg AD05707 | Single injection on day 1 |
| 7 | 0.5 mg/kg AD05708 | Single injection on day 1 |
| 8 | 0.5 mg/kg AD05709 | Single injection on day 1 |
| 9 | 0.5 mg/kg AD05251 | Single injection on day 1 |
| 10 | 0.5 mg/kg AD05169 | Single injection on day 1 |
| 11 | 0.5 mg/kg AD05710 | Single injection on day 1 |
| 12 | 0.5 mg/kg AD05711 | Single injection on day 1 |
| 13 | 0.5 mg/kg AD05712 | Single injection on day 1 |
| 14 | 0.5 mg/kg AD05713 | Single injection on day 1 |
| 15 | 0.5 mg/kg AD05220 | Single injection on day 1 |
| 16 | 0.5 mg/kg AD05714 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 4, 5, 6, and 7 for specific modifications and structure information related to the APOC3 RNAi agents).

The injections were performed between the skin and muscle (i.e. subcutaneous injections) into the loose skin over the neck and shoulder area. Three (3) mice in each Group were tested (n=3), except for Group 1 (D5W vehicle) where four (4) mice were tested (n=4). Serum was collected on day −1 (pre-dose bleed with a 4 hour fast), and days 8, and 15, 22, and 29. Mice were fasted for four hours prior to each collection. APOC3 expression levels were determined pursuant to the procedure set forth in Example 5, above. Triglycerides, high-density lipoprotein (HDL), low-density lipoprotein (LDL), and total cholesterol in serum were also measured on a Cobas® Integra 400 (Roche Diagnostics), according to the manufacturer's recommendations.

The APOC3 protein levels, triglyceride levels, HDL levels, and total cholesterol levels for each animal were normalized. For normalization, the level of APOC3 protein, triglyceride, HDL, LDL, and total cholesterol, respectively, for each animal at a time point, was divided by the pre-treatment level of expression in that animal (in this case at day −1) to determine the ratio of expression "normalized to pre-treatment." Expression at a specific time point was then normalized to the vehicle control group by dividing the "normalized to pre-treatment" ratio for an individual animal by the mean "normalized to pretreatment" ratio of all mice in the vehicle control group. This resulted in expression for each time point normalized to that in the control group. Data from the experiment are shown in the following Tables 16 through 20:

TABLE 16

Average APOC3 Protein Normalized to Pre-Treatment and Vehicle Control (D5W) from Example 8.

|  | Day 8 | | Day 15 | | Day 22 | | Day 29 | |
| --- | --- | --- | --- | --- | --- | --- | --- | --- |
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group 1 (D5W) | 1.000 | 0.104 | 1.000 | 0.297 | 1.000 | 0.343 | 1.000 | 0.354 |
| Group 2 (0.5 mg/kg AD05540) | 0.196 | 0.020 | 0.203 | 0.044 | 0.254 | 0.079 | 0.370 | 0.128 |

TABLE 16-continued

Average APOC3 Protein Normalized to Pre-Treatment and Vehicle Control (D5W) from Example 8.

| Group ID | Day 8 | | Day 15 | | Day 22 | | Day 29 | |
|---|---|---|---|---|---|---|---|---|
| | Avg APOC3 | Std Dev (+/−) | Avg APOC3 | Std Dev (+/−) | Avg APOC3 | Std Dev (+/−) | Avg APOC3 | Std Dev (+/−) |
| Group 3 (0.5 mg/kg AD05283) | 0.178 | 0.077 | 0.195 | 0.080 | 0.282 | 0.070 | 0.331 | 0.038 |
| Group 4 (0.5 mg/kg AD05705) | 0.146 | 0.053 | 0.150 | 0.050 | 0.239 | 0.080 | 0.330 | 0.111 |
| Group 5 (0.5 mg/kg AD05706) | 0.153 | 0.067 | 0.156 | 0.076 | 0.206 | 0.068 | 0.309 | 0.065 |
| Group 6 (0.5 mg/kg AD05707) | 0.102 | 0.030 | 0.158 | 0.023 | 0.227 | 0.035 | 0.441 | 0.160 |
| Group 7 (0.5 mg/kg AD05708) | 0.203 | 0.091 | 0.211 | 0.079 | 0.264 | 0.098 | 0.504 | 0.237 |
| Group 8 (0.5 mg/kg AD05709) | 0.213 | 0.086 | 0.190 | 0.078 | 0.299 | 0.143 | 0.467 | 0.250 |
| Group 9 (0.5 mg/kg AD05251) | 0.170 | 0.062 | 0.142 | 0.062 | 0.138 | 0.073 | 0.184 | 0.061 |
| Group 10 (0.5 mg/kg AD05169) | 0.290 | 0.131 | 0.320 | 0.054 | 0.309 | 0.039 | 0.433 | 0.060 |
| Group 11 (0.5 mg/kg AD05710) | 0.379 | 0.024 | 0.481 | 0.146 | 0.696 | 0.116 | 0.790 | 0.171 |
| Group 12 (0.5 mg/kg AD05711) | 0.331 | 0.028 | 0.325 | 0.036 | 0.334 | 0.037 | 0.545 | 0.238 |
| Group 13 (0.5 mg/kg AD05712) | 0.208 | 0.058 | 0.223 | 0.130 | 0.247 | 0.132 | 0.419 | 0.227 |
| Group 14 (0.5 mg/kg AD05713) | 0.216 | 0.092 | 0.305 | 0.131 | 0.453 | 0.070 | 0.646 | 0.053 |
| Group 15 (0.5 mg/kg AD05220) | 0.232 | 0.104 | 0.125 | 0.071 | 0.205 | 0.129 | 0.333 | 0.192 |
| Group 16 (0.5 mg/kg AD05714) | 0.338 | 0.025 | 0.259 | 0.069 | 0.422 | 0.012 | 0.550 | 0.092 |

TABLE 17

Average Triglycerides Normalized to Pre-Treatment and Vehicle Control (D5W) from Example 8.

| Group ID | Day 8 | | Day 15 | | Day 22 | | Day 29 | |
|---|---|---|---|---|---|---|---|---|
| | Avg TG | Std Dev (+/−) | Avg TG | Std Dev (+/−) | Avg TG | Std Dev (+/−) | Avg TG | Std Dev (+/−) |
| Group 1 (D5W) | 1.000 | 0.279 | 1.000 | 0.454 | 1.000 | 0.423 | 1.000 | 0.440 |
| Group 2 (0.5 mg/kg AD05540) | 0.232 | 0.041 | 0.218 | 0.072 | 0.264 | 0.111 | 0.370 | 0.192 |
| Group 3 (0.5 mg/kg AD05283) | 0.222 | 0.154 | 0.225 | 0.153 | 0.319 | 0.188 | 0.358 | 0.117 |
| Group 4 (0.5 mg/kg AD05705) | 0.141 | 0.036 | 0.123 | 0.033 | 0.237 | 0.088 | 0.338 | 0.098 |
| Group 5 (0.5 mg/kg AD05706) | 0.154 | 0.073 | 0.145 | 0.093 | 0.218 | 0.124 | 0.316 | 0.121 |
| Group 6 (0.5 mg/kg AD05707) | 0.109 | 0.049 | 0.156 | 0.069 | 0.184 | 0.030 | 0.433 | 0.267 |
| Group 7 (0.5 mg/kg AD05708) | 0.279 | 0.154 | 0.259 | 0.139 | 0.229 | 0.118 | 0.674 | 0.426 |
| Group 8 (0.5 mg/kg AD05709) | 0.283 | 0.155 | 0.221 | 0.134 | 0.274 | 0.154 | 0.606 | 0.393 |
| Group 9 (0.5 mg/kg AD05251) | 0.340 | 0.248 | 0.322 | 0.232 | 0.294 | 0.203 | 0.372 | 0.262 |
| Group 10 (0.5 mg/kg AD05169) | 0.274 | 0.202 | 0.306 | 0.078 | 0.276 | 0.062 | 0.341 | 0.118 |
| Group 11 (0.5 mg/kg AD05710) | 0.360 | 0.087 | 0.409 | 0.197 | 0.700 | 0.155 | 0.707 | 0.276 |
| Group 12 (0.5 mg/kg AD05711) | 0.268 | 0.096 | 0.288 | 0.061 | 0.293 | 0.054 | 0.488 | 0.248 |
| Group 13 (0.5 mg/kg AD05712) | 0.170 | 0.068 | 0.171 | 0.100 | 0.213 | 0.127 | 0.448 | 0.264 |
| Group 14 (0.5 mg/kg AD05713) | 0.183 | 0.088 | 0.262 | 0.148 | 0.399 | 0.083 | 0.581 | 0.135 |
| Group 15 (0.5 mg/kg AD05220) | 0.208 | 0.121 | 0.081 | 0.048 | 0.280 | 0.135 | 0.351 | 0.263 |
| Group 16 (0.5 mg/kg AD05714) | 0.319 | 0.082 | 0.242 | 0.101 | 0.461 | 0.059 | 0.596 | 0.150 |

TABLE 18

Average Total Cholesterol Normalized to Pre-Treatment and Vehicle Control (D5W) from Example 8.

| Group ID | Day 8 | | Day 15 | | Day 22 | | Day 29 | |
|---|---|---|---|---|---|---|---|---|
| | Avg Total Chol | Std Dev (+/−) | Avg Total Chol | Std Dev (+/−) | Avg Total Chol | Std Dev (+/−) | Avg Total Chol | Std Dev (+/−) |
| Group 1 (D5W) | 1.000 | 0.063 | 1.000 | 0.370 | 1.000 | 0.386 | 1.000 | 0.335 |
| Group 2 (0.5 mg/kg AD05540) | 0.414 | 0.103 | 0.464 | 0.144 | 0.483 | 0.179 | 0.583 | 0.214 |
| Group 3 (0.5 mg/kg AD05283) | 0.488 | 0.215 | 0.498 | 0.203 | 0.573 | 0.197 | 0.597 | 0.155 |
| Group 4 (0.5 mg/kg AD05705) | 0.377 | 0.230 | 0.359 | 0.205 | 0.401 | 0.198 | 0.429 | 0.199 |
| Group 5 (0.5 mg/kg AD05706) | 0.342 | 0.108 | 0.357 | 0.099 | 0.360 | 0.098 | 0.437 | 0.091 |
| Group 6 (0.5 mg/kg AD05707) | 0.271 | 0.196 | 0.294 | 0.176 | 0.322 | 0.176 | 0.441 | 0.235 |
| Group 7 (0.5 mg/kg AD05708) | 0.435 | 0.203 | 0.457 | 0.203 | 0.523 | 0.230 | 0.629 | 0.290 |
| Group 8 (0.5 mg/kg AD05709) | 0.455 | 0.233 | 0.436 | 0.197 | 0.454 | 0.216 | 0.590 | 0.321 |
| Group 9 (0.5 mg/kg AD05251) | 0.504 | 0.313 | 0.554 | 0.345 | 0.533 | 0.327 | 0.636 | 0.398 |
| Group 10 (0.5 mg/kg AD05169) | 0.544 | 0.240 | 0.595 | 0.285 | 0.538 | 0.235 | 0.578 | 0.155 |
| Group 11 (0.5 mg/kg AD05710) | 0.686 | 0.138 | 0.810 | 0.240 | 0.916 | 0.185 | 0.987 | 0.242 |
| Group 12 (0.5 mg/kg AD05711) | 0.493 | 0.105 | 0.457 | 0.094 | 0.483 | 0.076 | 0.658 | 0.222 |
| Group 13 (0.5 mg/kg AD05712) | 0.414 | 0.214 | 0.440 | 0.258 | 0.416 | 0.227 | 0.556 | 0.322 |
| Group 14 (0.5 mg/kg AD05713) | 0.354 | 0.148 | 0.441 | 0.187 | 0.557 | 0.108 | 0.658 | 0.014 |
| Group 15 (0.5 mg/kg AD05220) | 0.393 | 0.227 | 0.418 | 0.273 | 0.427 | 0.288 | 0.526 | 0.271 |
| Group 16 (0.5 mg/kg AD05714) | 0.632 | 0.014 | 0.706 | 0.011 | 0.797 | 0.030 | 0.932 | 0.070 |

TABLE 19

Average HDL Normalized to Pre-Treatment and Vehicle Control (D5W) from Example 8.

| Group ID | Day 8 | | Day 15 | | Day 22 | | Day 29 | |
|---|---|---|---|---|---|---|---|---|
| | Avg HDL | Std Dev (+/−) | Avg HDL | Std Dev (+/−) | Avg HDL | Std Dev (+/−) | Avg HDL | Std Dev (+/−) |
| Group 1 (D5W) | 1.000 | 0.365 | 1.000 | 0.141 | 1.000 | 0.100 | 1.000 | 0.338 |
| Group 2 (0.5 mg/kg AD05540) | 1.489 | 0.197 | 1.676 | 0.305 | 2.040 | 0.388 | 1.629 | 0.375 |
| Group 3 (0.5 mg/kg AD05283) | 2.192 | 1.116 | 2.227 | 1.009 | 2.859 | 1.499 | 1.982 | 0.785 |
| Group 4 (0.5 mg/kg AD05705) | 1.558 | 0.433 | 1.531 | 0.260 | 1.772 | 0.334 | 0.953 | 0.316 |
| Group 5 (0.5 mg/kg AD05706) | 2.248 | 0.626 | 2.556 | 0.938 | 2.736 | 0.875 | 1.878 | 0.629 |
| Group 6 (0.5 mg/kg AD05707) | 1.179 | 0.038 | 1.221 | 0.162 | 1.352 | 0.204 | 1.100 | 0.266 |
| Group 7 (0.5 mg/kg AD05708) | 1.086 | 0.158 | 1.187 | 0.252 | 1.670 | 0.203 | 0.972 | 0.400 |
| Group 8 (0.5 mg/kg AD05709) | 1.251 | 0.187 | 1.308 | 0.280 | 1.519 | 0.299 | 1.000 | 0.346 |
| Group 9 (0.5 mg/kg AD05251) | 1.337 | 0.326 | 1.369 | 0.372 | 1.961 | 0.901 | 1.426 | 0.438 |
| Group 10 (0.5 mg/kg AD05169) | 1.239 | 0.023 | 1.050 | 0.436 | 1.180 | 0.633 | 1.242 | 0.416 |
| Group 11 (0.5 mg/kg AD05710) | 1.169 | 0.089 | 1.417 | 0.356 | 1.359 | 0.149 | 1.244 | 0.290 |
| Group 12 (0.5 mg/kg AD05711) | 1.666 | 0.481 | 1.360 | 0.314 | 1.607 | 0.627 | 1.486 | 0.824 |
| Group 13 (0.5 mg/kg AD05712) | 1.255 | 0.577 | 1.214 | 0.560 | 1.344 | 0.587 | 0.939 | 0.427 |
| Group 14 (0.5 mg/kg AD05713) | 1.324 | 0.264 | 1.347 | 0.402 | 1.519 | 0.673 | 1.047 | 0.507 |
| Group 15 (0.5 mg/kg AD05220) | 0.763 | 0.345 | 0.954 | 0.539 | 1.042 | 0.533 | 0.963 | 0.093 |
| Group 16 (0.5 mg/kg AD05714) | 0.960 | 0.145 | 1.099 | 0.151 | 1.382 | 0.108 | 1.124 | 0.022 |

TABLE 20

Average LDL Normalized to Pre-Treatment and Vehicle Control (D5W) from Example 8.

| Group ID | Day 8 | | Day 15 | | Day 22 | | Day 29 | |
|---|---|---|---|---|---|---|---|---|
| | Avg LDL | Std Dev (+/−) | Avg LDL | Std Dev (+/−) | Avg LDL | Std Dev (+/−) | Avg LDL | Std Dev (+/−) |
| Group 1 (D5W) | 1.000 | 0.314 | 1.000 | 0.350 | 1.000 | 0.448 | 1.000 | 0.268 |
| Group 2 (0.5 mg/kg AD05540) | 0.265 | 0.076 | 0.318 | 0.100 | 0.340 | 0.104 | 0.517 | 0.199 |
| Group 3 (0.5 mg/kg AD05283) | 0.404 | 0.201 | 0.426 | 0.209 | 0.560 | 0.292 | 0.596 | 0.166 |
| Group 4 (0.5 mg/kg AD05705) | 0.303 | 0.245 | 0.271 | 0.209 | 0.315 | 0.191 | 0.378 | 0.224 |
| Group 5 (0.5 mg/kg AD05706) | 0.226 | 0.101 | 0.272 | 0.056 | 0.266 | 0.052 | 0.367 | 0.067 |
| Group 6 (0.5 mg/kg AD05707) | 0.160 | 0.128 | 0.204 | 0.146 | 0.259 | 0.159 | 0.337 | 0.164 |
| Group 7 (0.5 mg/kg AD05708) | 0.251 | 0.130 | 0.281 | 0.100 | 0.459 | 0.214 | 0.445 | 0.137 |
| Group 8 (0.5 mg/kg AD05709) | 0.242 | 0.135 | 0.230 | 0.077 | 0.389 | 0.209 | 0.371 | 0.166 |
| Group 9 (0.5 mg/kg AD05251) | 0.467 | 0.338 | 0.542 | 0.351 | 0.688 | 0.478 | 0.836 | 0.547 |
| Group 10 (0.5 mg/kg AD05169) | 0.341 | 0.064 | 0.495 | 0.395 | 0.396 | 0.197 | 0.459 | 0.106 |
| Group 11 (0.5 mg/kg AD05710) | 0.742 | 0.257 | 0.997 | 0.398 | 0.944 | 0.357 | 1.228 | 0.474 |
| Group 12 (0.5 mg/kg AD05711) | 0.526 | 0.135 | 0.401 | 0.116 | 0.737 | 0.388 | 0.919 | 0.367 |
| Group 13 (0.5 mg/kg AD05712) | 0.373 | 0.156 | 0.423 | 0.182 | 0.440 | 0.193 | 0.477 | 0.294 |
| Group 14 (0.5 mg/kg AD05713) | 0.312 | 0.159 | 0.370 | 0.144 | 0.736 | 0.194 | 1.007 | 0.242 |
| Group 15 (0.5 mg/kg AD05220) | 0.369 | 0.164 | 0.337 | 0.204 | 0.401 | 0.278 | 0.465 | 0.191 |
| Group 16 (0.5 mg/kg AD05714) | 0.440 | 0.062 | 0.500 | 0.055 | 0.710 | 0.114 | 0.842 | 0.229 |

Each of the APOC3 RNAi agents in each of the dosing groups (i.e., Groups 2 through 16) showed a reduction in APOC3 protein levels, triglyceride levels, total cholesterol levels, and LDL levels as compared to the control (Group 1). For example, a single 0.5 mg/kg dose of APOC3 RNAi agent AD05251 (Group 7) showed at day 22 a reduction of approximately 86% of APOC3 protein levels (0.138), a reduction of approximately 70% in triglyceride levels (0.294), a reduction of approximately 47% of total cholesterol levels (0.533), and a reduction of approximately 31% in LDL levels (0.688). Further, as anticipated, on day 22 the administration of AD05251 showed an increase in HDL levels (see, e.g., Table 19 above).

Example 9. In Vivo Dose Response Testing of APOC3 RNAi Agents in APOC3 Transgenic Mice The APOC3 Transgenic Mouse Model described in Example 5, above, was used. At day 1, each mouse was given a single subcutaneous administration of 200 μl of the respective RNAi agent dissolved in D5W (dextrose in 5% water) or control (D5W) according to the dosing groups shown in the following Table 21:

TABLE 21

Dosing groups of Example 9.

| Group | RNAi Agent and Dose | Dosing Regimen |
|---|---|---|
| 1 | D5W (no RNAi agent) | Single injection on day 1 |
| 2 | 0.01 mg/kg AD05876 | Single injection on day 1 |
| 3 | 0.05 mg/kg AD05876 | Single injection on day 1 |
| 4 | 0.1 mg/kg AD05876 | Single injection on day 1 |
| 5 | 0.25 mg/kg AD05876 | Single injection on day 1 |
| 6 | 0.5 mg/kg AD05876 | Single injection on day 1 |
| 7 | 1.0 mg/kg AD05876 | Single injection on day 1 |
| 8 | 3.0 mg/kg AD05876 | Single injection on day 1 |
| 9 | 0.01 mg/kg AD05251 | Single injection on day 1 |
| 10 | 0.05 mg/kg AD05251 | Single injection on day 1 |
| 11 | 0.1 mg/kg AD05251 | Single injection on day 1 |
| 12 | 0.25 mg/kg AD05251 | Single injection on day 1 |

TABLE 21-continued

Dosing groups of Example 9.

| Group | RNAi Agent and Dose | Dosing Regimen |
|---|---|---|
| 13 | 0.5 mg/kg AD05251 | Single injection on day 1 |
| 14 | 1.0 mg/kg AD05251 | Single injection on day 1 |
| 15 | 3.0 mg/kg AD05251 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the structure of (NAG37)s. (See Tables 4, 5, 6, and 7 for specific modifications and structure information related to the APOC3 RNAi agents).

The injections were performed between the skin and muscle (i.e. subcutaneous injections) into the loose skin over the neck and shoulder area. Four (4) mice in each Group were tested. Serum was collected on day −1 (pre-dose bleed with a 4 hour fast), and days 8, 15, 22, 29, and 36. Mice were fasted for four hours prior to each collection. APOC3 expression levels, triglycerides, high-density lipoprotein (HDL), low-density lipoprotein (LDL), and total cholesterol in serum were measured on a Cobas® Integra 400 (Roche Diagnostics), according to the manufacturer's recommendations.

The APOC3 protein levels, triglyceride levels, HDL levels, and total cholesterol levels for each animal were normalized. For normalization, the level of APOC3 protein, triglyceride, HDL, LDL, and total cholesterol, respectively, for each animal at a time point, was divided by the pre-treatment level of expression in that animal (in this case at day −1) to determine the ratio of expression "normalized to pre-dose." Data from the experiment are shown in the following Tables 22 through 26:

TABLE 22

Average APOC3 Protein Normalized to Pre-Dose from Example 9.

| | Day 8 | | Day 15 | | Day 22 | | Day 29 | | Day 36 | |
|---|---|---|---|---|---|---|---|---|---|---|
| Group ID | Avg APOC3 | Std Dev (+/−) | Avg APOC3 | Std Dev (+/−) | Avg APOC3 | Std Dev (+/−) | Avg APOC3 | Std Dev (+/−) | Avg APOC3 | Std Dev (+/−) |
| Group 1 (D5W) | 1.205 | 0.162 | 1.224 | 0.145 | 1.102 | 0.257 | 1.011 | 0.148 | 1.103 | 0.133 |
| Group 2 (0.01 mg/kg AD05876) | 0.859 | 0.255 | 0.970 | 0.231 | 1.050 | 0.101 | 1.001 | 0.091 | 0.990 | 0.121 |
| Group 3 (0.05 mg/kg AD05876) | 0.835 | 0.048 | 0.933 | 0.154 | 0.919 | 0.166 | 1.094 | 0.259 | 1.111 | 0.244 |
| Group 4 (0.1 mg/kg AD05876) | 0.472 | 0.053 | 0.630 | 0.047 | 0.742 | 0.100 | 0.798 | 0.117 | 0.937 | 0.064 |
| Group 5 (0.25 mg/kg AD05876) | 0.342 | 0.049 | 0.423 | 0.045 | 0.495 | 0.056 | 0.734 | 0.066 | 0.812 | 0.097 |
| Group 6 (0.5 mg/kg AD05876) | 0.188 | 0.030 | 0.211 | 0.045 | 0.289 | 0.029 | 0.386 | 0.047 | 0.504 | 0.050 |
| Group 7 (1.0 mg/kg AD05876) | 0.164 | 0.033 | 0.207 | 0.036 | 0.250 | 0.045 | 0.332 | 0.097 | 0.446 | 0.152 |
| Group 8 (3.0 mg/kg AD05876) | 0.086 | 0.015 | 0.110 | 0.024 | 0.128 | 0.037 | 0.141 | 0.023 | 0.157 | 0.031 |
| Group 9 (0.01 mg/kg AD05251) | 1.165 | 0.101 | 1.051 | 0.040 | 0.955 | 0.105 | 1.038 | 0.033 | 0.968 | 0.079 |
| Group 10 (0.05 mg/kg AD05251) | 0.675 | 0.051 | 0.694 | 0.056 | 0.692 | 0.046 | 0.836 | 0.139 | 0.921 | 0.087 |
| Group 11 (0.1 mg/kg AD05251) | 0.590 | 0.098 | 0.478 | 0.073 | 0.562 | 0.067 | 0.625 | 0.054 | 0.686 | 0.084 |
| Group 12 (0.25 mg/kg AD05251) | 0.273 | 0.067 | 0.295 | 0.039 | 0.354 | 0.055 | 0.479 | 0.137 | 0.580 | 0.071 |
| Group 13 (0.5 mg/kg AD05251) | 0.219 | 0.066 | 0.211 | 0.045 | 0.283 | 0.070 | 0.291 | 0.090 | 0.338 | 0.085 |
| Group 14 (1.0 mg/kg AD05251) | 0.157 | 0.026 | 0.143 | 0.034 | 0.230 | 0.067 | 0.280 | 0.093 | 0.310 | 0.072 |
| Group 15 (3.0 mg/kg AD05251) | 0.135 | 0.033 | 0.131 | 0.022 | 0.164 | 0.036 | 0.157 | 0.048 | 0.191 | 0.056 |

TABLE 23

Average Triglycerides Normalized to Pre-Dose from Example 9.

| | Day 8 | | Day 15 | | Day 22 | | Day 29 | | Day 36 | |
|---|---|---|---|---|---|---|---|---|---|---|
| Group ID | Avg TG | Std Dev (+/−) | Avg TG | Std Dev (+/−) | Avg TG | Std Dev (+/−) | Avg TG | Std Dev (+/−) | Avg TG | Std Dev (+/−) |
| Group 1 (D5W) | 1.441 | 0.335 | 1.723 | 0.177 | 1.253 | 0.377 | 1.151 | 0.301 | 1.304 | 0.221 |
| Group 2 (0.01 mg/kg AD05876) | 0.988 | 0.436 | 1.139 | 0.421 | 1.177 | 0.271 | 1.209 | 0.242 | 1.259 | 0.325 |
| Group 3 (0.05 mg/kg AD05876) | 1.146 | 0.303 | 1.321 | 0.459 | 0.964 | 0.355 | 1.428 | 0.613 | 1.275 | 0.456 |
| Group 4 (0.1 mg/kg AD05876) | 0.671 | 0.176 | 0.700 | 0.131 | 0.912 | 0.204 | 0.918 | 0.265 | 1.073 | 0.175 |
| Group 5 (0.25 mg/kg AD05876) | 0.391 | 0.081 | 0.581 | 0.174 | 0.608 | 0.141 | 0.960 | 0.205 | 0.989 | 0.196 |
| Group 6 (0.5 mg/kg AD05876) | 0.216 | 0.060 | 0.202 | 0.054 | 0.306 | 0.092 | 0.465 | 0.147 | 0.493 | 0.066 |
| Group 7 (1.0 mg/kg AD05876) | 0.227 | 0.099 | 0.326 | 0.147 | 0.366 | 0.096 | 0.427 | 0.150 | 0.600 | 0.261 |
| Group 8 (3.0 mg/kg AD05876) | 0.090 | 0.024 | 0.166 | 0.037 | 0.165 | 0.044 | 0.184 | 0.048 | 0.222 | 0.037 |
| Group 9 (0.01 mg/kg AD05251) | 1.357 | 0.266 | 1.197 | 0.099 | 1.024 | 0.129 | 1.197 | 0.101 | 1.118 | 0.215 |
| Group 10 (0.05 mg/kg AD05251) | 0.784 | 0.137 | 0.950 | 0.278 | 0.725 | 0.137 | 1.013 | 0.270 | 1.108 | 0.257 |
| Group 11 (0.1 mg/kg AD05251) | 0.634 | 0.182 | 0.583 | 0.110 | 0.587 | 0.160 | 0.641 | 0.123 | 0.702 | 0.172 |
| Group 12 (0.25 mg/kg AD05251) | 0.330 | 0.119 | 0.397 | 0.076 | 0.393 | 0.042 | 0.583 | 0.236 | 0.614 | 0.057 |
| Group 13 (0.5 mg/kg AD05251) | 0.250 | 0.084 | 0.197 | 0.040 | 0.283 | 0.034 | 0.309 | 0.102 | 0.355 | 0.118 |
| Group 14 (1.0 mg/kg AD05251) | 0.213 | 0.054 | 0.171 | 0.073 | 0.273 | 0.059 | 0.384 | 0.135 | 0.347 | 0.079 |
| Group 15 (3.0 mg/kg AD05251) | 0.210 | 0.067 | 0.172 | 0.024 | 0.235 | 0.089 | 0.213 | 0.032 | 0.263 | 0.106 |

TABLE 24

Average Total Cholesterol Normalized to Pre-Dose from Example 9.

| Group ID | Day 8 | | Day 15 | | Day 22 | | Day 29 | | Day 36 | |
|---|---|---|---|---|---|---|---|---|---|---|
| | Avg Total Chol | Std Dev (+/−) | Avg Total Chol | Std Dev (+/−) | Avg Total Chol | Std Dev (+/−) | Avg Total Chol | Std Dev (+/−) | Avg Total Chol | Std Dev (+/−) |
| Group 1 (D5W) | 1.177 | 0.079 | 1.261 | 0.169 | 1.161 | 0.297 | 1.049 | 0.188 | 1.151 | 0.167 |
| Group 2 (0.01 mg/kg AD05876) | 1.020 | 0.231 | 1.099 | 0.186 | 1.193 | 0.147 | 1.132 | 0.087 | 1.141 | 0.157 |
| Group 3 (0.05 mg/kg AD05876) | 0.975 | 0.105 | 1.003 | 0.193 | 1.010 | 0.192 | 1.169 | 0.296 | 1.160 | 0.265 |
| Group 4 (0.1 mg/kg AD05876) | 0.694 | 0.115 | 0.749 | 0.101 | 0.851 | 0.122 | 0.876 | 0.155 | 1.005 | 0.063 |
| Group 5 (0.25 mg/kg AD05876) | 0.670 | 0.188 | 0.744 | 0.229 | 0.792 | 0.190 | 0.953 | 0.116 | 0.928 | 0.157 |
| Group 6 (0.5 mg/kg AD05876) | 0.556 | 0.146 | 0.600 | 0.178 | 0.628 | 0.127 | 0.672 | 0.126 | 0.768 | 0.107 |
| Group 7 (1.0 mg/kg AD05876) | 0.596 | 0.081 | 0.634 | 0.145 | 0.664 | 0.134 | 0.710 | 0.101 | 0.760 | 0.083 |
| Group 8 (3.0 mg/kg AD05876) | 0.547 | 0.057 | 0.556 | 0.104 | 0.589 | 0.130 | 0.564 | 0.098 | 0.572 | 0.101 |
| Group 9 (0.01 mg/kg AD05251) | 1.236 | 0.107 | 1.142 | 0.063 | 1.023 | 0.139 | 1.099 | 0.107 | 1.106 | 0.115 |
| Group 10 (0.05 mg/kg AD05251) | 0.785 | 0.083 | 0.813 | 0.107 | 0.784 | 0.106 | 0.944 | 0.147 | 0.995 | 0.135 |
| Group 11 (0.1 mg/kg AD05251) | 0.721 | 0.080 | 0.691 | 0.068 | 0.706 | 0.065 | 0.737 | 0.028 | 0.814 | 0.060 |
| Group 12 (0.25 mg/kg AD05251) | 0.562 | 0.115 | 0.617 | 0.104 | 0.632 | 0.081 | 0.705 | 0.076 | 0.777 | 0.044 |
| Group 13 (0.5 mg/kg AD05251) | 0.479 | 0.055 | 0.492 | 0.037 | 0.540 | 0.073 | 0.543 | 0.098 | 0.564 | 0.095 |
| Group 14 (1.0 mg/kg AD05251) | 0.634 | 0.137 | 0.687 | 0.163 | 0.634 | 0.172 | 0.669 | 0.163 | 0.700 | 0.174 |
| Group 15 (3.0 mg/kg AD05251) | 0.602 | 0.106 | 0.611 | 0.101 | 0.632 | 0.121 | 0.627 | 0.167 | 0.594 | 0.121 |

TABLE 25

Average HDL Normalized to Pre-Dose from Example 9.

| Group ID | Day 8 | | Day 15 | | Day 22 | | Day 29 | | Day 36 | |
|---|---|---|---|---|---|---|---|---|---|---|
| | Avg HDL | Std Dev (+/−) | Avg HDL | Std Dev (+/−) | Avg HDL | Std Dev (+/−) | Avg HDL | Std Dev (+/−) | Avg HDL | Std Dev (+/−) |
| Group 1 (D5W) | 0.883 | 0.115 | 0.855 | 0.013 | 0.919 | 0.081 | 1.070 | 0.128 | 0.905 | 0.109 |
| Group 2 (0.01 mg/kg AD05876) | 1.029 | 0.087 | 1.086 | 0.209 | 0.987 | 0.191 | 1.096 | 0.088 | 0.969 | 0.100 |
| Group 3 (0.05 mg/kg AD05876) | 0.786 | 0.184 | 0.968 | 0.121 | 1.052 | 0.130 | 0.951 | 0.252 | 0.886 | 0.221 |
| Group 4 (0.1 mg/kg AD05876) | 1.129 | 0.133 | 1.147 | 0.098 | 1.022 | 0.213 | 1.109 | 0.106 | 0.911 | 0.177 |
| Group 5 (0.25 mg/kg AD05876) | 1.280 | 0.238 | 1.336 | 0.253 | 1.244 | 0.172 | 1.083 | 0.083 | 0.992 | 0.082 |
| Group 6 (0.5 mg/kg AD05876) | 1.516 | 0.241 | 1.574 | 0.182 | 1.368 | 0.185 | 1.327 | 0.172 | 1.350 | 0.237 |
| Group 7 (1.0 mg/kg AD05876) | 1.361 | 0.243 | 1.327 | 0.318 | 1.298 | 0.173 | 1.330 | 0.208 | 1.206 | 0.262 |
| Group 8 (3.0 mg/kg AD05876) | 1.620 | 0.459 | 1.452 | 0.347 | 1.542 | 0.371 | 1.477 | 0.227 | 1.417 | 0.322 |
| Group 9 (0.01 mg/kg AD05251) | 0.833 | 0.143 | 0.808 | 0.133 | 0.856 | 0.154 | 0.936 | 0.127 | 1.041 | 0.193 |
| Group 10 (0.05 mg/kg AD05251) | 1.036 | 0.111 | 0.913 | 0.017 | 1.027 | 0.030 | 0.974 | 0.168 | 0.976 | 0.142 |
| Group 11 (0.1 mg/kg AD05251) | 1.075 | 0.087 | 1.087 | 0.065 | 1.033 | 0.116 | 1.021 | 0.114 | 1.074 | 0.074 |
| Group 12 (0.25 mg/kg AD05251) | 1.118 | 0.094 | 1.175 | 0.062 | 1.100 | 0.051 | 1.142 | 0.146 | 1.152 | 0.113 |
| Group 13 (0.5 mg/kg AD05251) | 1.344 | 0.178 | 1.455 | 0.124 | 1.329 | 0.190 | 1.347 | 0.156 | 1.279 | 0.188 |
| Group 14 (1.0 mg/kg AD05251) | 1.338 | 0.143 | 1.501 | 0.175 | 1.179 | 0.221 | 1.218 | 0.247 | 1.282 | 0.179 |
| Group 15 (3.0 mg/kg AD05251) | 1.332 | 0.150 | 1.426 | 0.264 | 1.348 | 0.133 | 1.431 | 0.339 | 1.265 | 0.184 |

TABLE 26

Average LDL Normalized to Pre-Dose from Example 9.

| Group ID | Day 8 | | Day 15 | | Day 22 | | Day 29 | | Day 36 | |
|---|---|---|---|---|---|---|---|---|---|---|
| | Avg LDL | Std Dev (+/−) | Avg LDL | Std Dev (+/−) | Avg LDL | Std Dev (+/−) | Avg LDL | Std Dev (+/−) | Avg LDL | Std Dev (+/−) |
| Group 1 (D5W) | 1.060 | 0.159 | 0.990 | 0.210 | 1.078 | 0.325 | 0.989 | 0.365 | 0.881 | 0.135 |
| Group 2 (0.01 mg/kg AD05876) | 1.031 | 0.068 | 1.071 | 0.181 | 1.077 | 0.082 | 0.992 | 0.154 | 0.958 | 0.081 |
| Group 3 (0.05 mg/kg AD05876) | 0.799 | 0.179 | 0.682 | 0.223 | 0.859 | 0.177 | 0.959 | 0.289 | 0.954 | 0.176 |
| Group 4 (0.1 mg/kg AD05876) | 0.535 | 0.019 | 0.593 | 0.071 | 0.636 | 0.145 | 0.692 | 0.100 | 0.840 | 0.089 |
| Group 5 (0.25 mg/kg AD05876) | 0.645 | 0.153 | 0.570 | 0.152 | 0.660 | 0.158 | 0.783 | 0.083 | 0.676 | 0.096 |
| Group 6 (0.5 mg/kg AD05876) | 0.624 | 0.238 | 0.645 | 0.192 | 0.620 | 0.067 | 0.581 | 0.086 | 0.893 | 0.088 |
| Group 7 (1.0 mg/kg AD05876) | 0.481 | 0.124 | 0.464 | 0.201 | 0.396 | 0.127 | 0.524 | 0.181 | 0.588 | 0.174 |
| Group 8 (3.0 mg/kg AD05876) | 0.455 | 0.161 | 0.465 | 0.154 | 0.428 | 0.159 | 0.359 | 0.099 | 0.382 | 0.140 |
| Group 9 (0.01 mg/kg AD05251) | 1.260 | 0.097 | 1.237 | 0.202 | 1.091 | 0.244 | 1.162 | 0.209 | 1.356 | 0.249 |
| Group 10 (0.05 mg/kg AD05251) | 0.682 | 0.048 | 0.641 | 0.127 | 0.715 | 0.032 | 0.792 | 0.123 | 0.847 | 0.223 |
| Group 11 (0.1 mg/kg AD05251) | 0.717 | 0.293 | 0.635 | 0.146 | 0.693 | 0.260 | 0.679 | 0.234 | 0.845 | 0.128 |
| Group 12 (0.25 mg/kg AD05251) | 0.439 | 0.151 | 0.502 | 0.147 | 0.614 | 0.190 | 0.552 | 0.037 | 0.716 | 0.205 |
| Group 13 (0.5 mg/kg AD05251) | 0.413 | 0.086 | 0.474 | 0.048 | 0.508 | 0.149 | 0.542 | 0.209 | 0.514 | 0.162 |
| Group 14 (1.0 mg/kg AD05251) | 0.614 | 0.268 | 0.747 | 0.292 | 0.601 | 0.266 | 0.633 | 0.282 | 0.669 | 0.271 |
| Group 15 (3.0 mg/kg AD05251) | 0.488 | 0.162 | 0.469 | 0.099 | 0.498 | 0.176 | 0.445 | 0.230 | 0.405 | 0.142 |

Each of the APOC3 RNAi agents tested exhibited a dose response in the reduction of APOC3 protein levels, triglyceride levels, total cholesterol levels, and LDL levels.

Example 10. In Vivo Dose Response Testing of APOC3 RNAi Agents in APOC3 Transgenic Mice The APOC3 Transgenic Mouse Model described in Example 5, above, was used. At day 1, each mouse was given a single subcutaneous administration of 200 µl of the respective RNAi agent dissolved in D5W (dextrose in 5% water) or control vehicle (D5W) according to the dosing groups shown in the following Table 27:

TABLE 27

Dosing groups of Example 10.

| Group | RNAi Agent and Dose | Dosing Regimen |
|---|---|---|
| 1 | D5W (no RNAi agent) | Single injection on day 1 |
| 2 | 0.25 mg/kg AD05891 | Single injection on day 1 |
| 3 | 0.25 mg/kg AD05892 | Single injection on day 1 |
| 4 | 0.25 mg/kg AD05893 | Single injection on day 1 |
| 5 | 0.25 mg/kg AD05894 | Single injection on day 1 |
| 6 | 0.25 mg/kg AD05895 | Single injection on day 1 |
| 7 | 0.25 mg/kg AD05896 | Single injection on day 1 |
| 8 | 0.25 mg/kg AD05897 | Single injection on day 1 |
| 9 | 0.25 mg/kg AD05889 | Single injection on day 1 |
| 10 | 0.25 mg/kg AD05890 | Single injection on day 1 |
| 11 | 0.25 mg/kg AD05876 | Single injection on day 1 |
| 12 | 0.25 mg/kg AD05877 | Single injection on day 1 |
| 13 | 0.25 mg/kg AD05878 | Single injection on day 1 |
| 14 | 0.25 mg/kg AD05879 | Single injection on day 1 |
| 15 | 0.25 mg/kg AD05880 | Single injection on day 1 |
| 16 | 0.25 mg/kg AD05882 | Single injection on day 1 |
| 17 | 0.25 mg/kg AD05884 | Single injection on day 1 |
| 18 | 0.25 mg/kg AD05885 | Single injection on day 1 |
| 19 | 0.25 mg/kg AD05886 | Single injection on day 1 |
| 20 | 0.25 mg/kg AD05887 | Single injection on day 1 |
| 21 | 0.25 mg/kg AD05888 | Single injection on day 1 |
| 22 | 0.25 mg/kg AD05769 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 4, 5, 6, and 7 for specific modifications and structure information related to the APOC3 RNAi agents).

The APOC3 RNAi agents tested in Example 10 included nucleotide sequences that were designed to target different positions on the APOC3 gene (i.e., SEQ ID NO:1). More specifically, Groups 2-4 (i.e., APOC3 RNAi agents AD05891, AD05892, and AD05893) included antisense strand sequences designed to target position 248 of an APOC3 gene; Group 5 (i.e., APOC3 RNAi agent AD05894) included an antisense strand sequence designed to target position 263 of an APOC3 gene; Groups 6-7 (i.e., APOC3 RNAi agents AD05895 and AD05896) included antisense strand sequences designed to target position 422 of an APOC3 gene; Group 8 (i.e., APOC3 RNAi agent AD05897) included an antisense strand sequence designed to target position 246 of an APOC3 gene; Groups 9-10 (i.e., APOC3 RNAi agents AD05889 and AD05890) included antisense strand sequences designed to target position 168 of an APOC3 gene; and Groups 11-22 (i.e., APOC3 RNAi agents AD05876, AD05877, AD05878, AD05878, AD05880, AD05882, AD05884, AD05885, AD05886, AD05887, AD05888, and AD05769) included antisense strand sequences designed to target position 438 of an APOC3 gene.

The injections were performed between the skin and muscle (i.e. subcutaneous injections) into the loose skin over the neck and shoulder area. Three (3) mice in each Group were tested (n=3). Serum was collected on day −1 (pre-dose bleed with a 4 hour fast), and days 8, 15. For mice dosed with the certain RNAi agents that exhibited relatively high inhibitory activity and for the mice dosed with the vehicle control, additional serum samples were collected on days 22 and 29. Mice were fasted for four hours prior to each collection. APOC3 expression levels, triglycerides, high-density lipoprotein (HDL), low-density lipoprotein (LDL), and total cholesterol in serum were measured on a Cobas® Integra 400 (Roche Diagnostics), according to the manufacturer's recommendations.

The APOC3 protein levels, triglyceride levels, HDL levels, and total cholesterol levels for each animal were normalized. For normalization, the level of APOC3 protein, triglyceride, HDL, LDL, and total cholesterol, respectively, for each animal at a time point, was divided by the pre-treatment level of expression in that animal (in this case at day −1) to determine the ratio of expression "normalized to pre-dose." Data from the experiment are shown in the following Tables 28 through 32:

TABLE 28

Average APOC3 Protein Normalized to Pre-Dose from Example 10.

| | Day 8 | | Day 15 | | Day 22 | | Day 29 | |
|---|---|---|---|---|---|---|---|---|
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group 1 (D5W) | 1.130 | 0.131 | 0.892 | 0.155 | 1.182 | 0.272 | 1.126 | 0.174 |
| Group 2 (0.25 mg/kg AD05891) | 0.944 | 0.060 | 0.874 | 0.037 | N/A | N/A | N/A | N/A |
| Group 3 (0.25 mg/kg AD05892) | 0.831 | 0.101 | 0.840 | 0.116 | N/A | N/A | N/A | N/A |
| Group 4 (0.25 mg/kg AD05893) | 1.030 | 0.030 | 1.020 | 0.137 | N/A | N/A | N/A | N/A |
| Group 5 (0.25 mg/kg AD05894) | 0.835 | 0.136 | 0.774 | 0.134 | N/A | N/A | N/A | N/A |
| Group 6 (0.25 mg/kg AD05895) | 0.771 | 0.186 | 0.632 | 0.157 | N/A | N/A | N/A | N/A |
| Group 7 (0.25 mg/kg AD05896) | 0.912 | 0.109 | 0.836 | 0.218 | N/A | N/A | N/A | N/A |
| Group 8 (0.25 mg/kg AD05897) | 0.726 | 0.102 | 0.777 | 0.134 | N/A | N/A | N/A | N/A |
| Group 9 (0.25 mg/kg AD05889) | 1.059 | 0.187 | 0.987 | 0.123 | N/A | N/A | N/A | N/A |
| Group 10 (0.25 mg/kg AD05890) | 0.984 | 0.091 | 1.119 | 0.145 | N/A | N/A | N/A | N/A |
| Group 11 (0.25 mg/kg AD05876) | 0.222 | 0.021 | 0.258 | 0.034 | 0.361 | 0.027 | 0.523 | 0.126 |
| Group 12 (0.25 mg/kg AD05877) | 0.457 | 0.034 | 0.392 | 0.065 | 0.492 | 0.134 | N/A | N/A |
| Group 13 (0.25 mg/kg AD05878) | 0.366 | 0.115 | 0.406 | 0.134 | 0.567 | 0.232 | N/A | N/A |
| Group 14 (0.25 mg/kg AD05879) | 0.560 | 0.082 | 0.493 | 0.121 | 0.679 | 0.085 | N/A | N/A |
| Group 15 (0.25 mg/kg AD05880) | 0.572 | 0.205 | 0.652 | 0.274 | N/A | N/A | N/A | N/A |
| Group 16 (0.25 mg/kg AD05882) | 1.117 | 0.230 | 1.160 | 0.188 | N/A | N/A | N/A | N/A |

TABLE 28-continued

Average APOC3 Protein Normalized to Pre-Dose from Example 10.

| Group ID | Day 8 | | Day 15 | | Day 22 | | Day 29 | |
|---|---|---|---|---|---|---|---|---|
| | Avg APOC3 | Std Dev (+/−) | Avg APOC3 | Std Dev (+/−) | Avg APOC3 | Std Dev (+/−) | Avg APOC3 | Std Dev (+/−) |
| Group 17 (0.25 mg/kg AD05884) | 0.425 | 0.103 | 0.444 | 0.158 | 0.580 | 0.180 | N/A | N/A |
| Group 18 (0.25 mg/kg AD05885) | 0.629 | 0.024 | 0.782 | 0.109 | N/A | N/A | N/A | N/A |
| Group 19 (0.25 mg/kg AD05886) | 1.041 | 0.474 | 1.256 | 0.634 | N/A | N/A | N/A | N/A |
| Group 20 (0.25 mg/kg AD05887) | 0.390 | 0.106 | 0.608 | 0.159 | N/A | N/A | N/A | N/A |
| Group 21 (0.25 mg/kg AD05888) | 0.429 | 0.107 | 0.591 | 0.105 | N/A | N/A | N/A | N/A |
| Group 22 (0.25 mg/kg AD05769) | 0.229 | 0.039 | 0.346 | 0.078 | 0.325 | 0.061 | 0.407 | 0.017 |

TABLE 29

Average Triglycerides Normalized to Pre-Dose from Example 10.

| Group ID | Day 8 | | Day 15 | | Day 22 | | Day 29 | |
|---|---|---|---|---|---|---|---|---|
| | Avg TG | Std Dev (+/−) | Avg TG | Std Dev (+/−) | Avg TG | Std Dev (+/−) | Avg TG | Std Dev (+/−) |
| Group 1 (D5W) | 1.357 | 0.213 | 0.942 | 0.220 | 1.389 | 0.468 | 1.225 | 0.268 |
| Group 2 (0.25 mg/kg AD05891) | 1.123 | 0.127 | 0.908 | 0.057 | N/A | N/A | N/A | N/A |
| Group 3 (0.25 mg/kg AD05892) | 0.924 | 0.039 | 0.859 | 0.202 | N/A | N/A | N/A | N/A |
| Group 4 (0.25 mg/kg AD05893) | 1.262 | 0.056 | 1.168 | 0.189 | N/A | N/A | N/A | N/A |
| Group 5 (0.25 mg/kg AD05894) | 0.903 | 0.297 | 0.834 | 0.239 | N/A | N/A | N/A | N/A |
| Group 6 (0.25 mg/kg AD05895) | 0.728 | 0.300 | 0.632 | 0.207 | N/A | N/A | N/A | N/A |
| Group 7 (0.25 mg/kg AD05896) | 0.929 | 0.107 | 0.907 | 0.268 | N/A | N/A | N/A | N/A |
| Group 8 (0.25 mg/kg AD05897) | 0.836 | 0.178 | 0.936 | 0.212 | N/A | N/A | N/A | N/A |
| Group 9 (0.25 mg/kg AD05889) | 1.162 | 0.270 | 1.096 | 0.270 | N/A | N/A | N/A | N/A |
| Group 10 (0.25 mg/kg AD05890) | 0.992 | 0.341 | 1.486 | 0.505 | N/A | N/A | N/A | N/A |
| Group 11 (0.25 mg/kg AD05876) | 0.234 | 0.054 | 0.316 | 0.091 | 0.333 | 0.026 | 0.581 | 0.203 |
| Group 12 (0.25 mg/kg AD05877) | 0.496 | 0.096 | 0.530 | 0.175 | 0.653 | 0.215 | N/A | N/A |
| Group 13 (0.25 mg/kg AD05878) | 0.450 | 0.214 | 0.619 | 0.314 | 0.781 | 0.434 | N/A | N/A |
| Group 14 (0.25 mg/kg AD05879) | 0.664 | 0.033 | 0.664 | 0.072 | 0.905 | 0.030 | N/A | N/A |
| Group 15 (0.25 mg/kg AD05880) | 0.726 | 0.384 | 0.790 | 0.399 | N/A | N/A | N/A | N/A |
| Group 16 (0.25 mg/kg AD05882) | 1.289 | 0.436 | 1.695 | 0.408 | N/A | N/A | N/A | N/A |
| Group 17 (0.25 mg/kg AD05884) | 0.376 | 0.132 | 0.554 | 0.283 | 0.605 | 0.296 | N/A | N/A |
| Group 18 (0.25 mg/kg AD05885) | 0.620 | 0.064 | 0.998 | 0.219 | N/A | N/A | N/A | N/A |
| Group 19 (0.25 mg/kg AD05886) | 1.315 | 0.665 | 1.941 | 1.267 | N/A | N/A | N/A | N/A |
| Group 20 (0.25 mg/kg AD05887) | 0.445 | 0.193 | 0.867 | 0.335 | N/A | N/A | N/A | N/A |
| Group 21 (0.25 mg/kg AD05888) | 0.467 | 0.227 | 0.700 | 0.190 | N/A | N/A | N/A | N/A |
| Group 22 (0.25 mg/kg AD05769) | 0.204 | 0.033 | 0.377 | 0.068 | 0.373 | 0.097 | 0.370 | 0.071 |

TABLE 30

Average Total Cholesterol Normalized to Pre-Dose from Example 10.

| Group ID | Day 8 | | Day 15 | | Day 22 | | Day 29 | |
|---|---|---|---|---|---|---|---|---|
| | Avg Total Chol | Std Dev (+/−) | Avg Total Chol | Std Dev (+/−) | Avg Total Chol | Std Dev (+/−) | Avg Total Chol | Std Dev (+/−) |
| Group 1 (D5W) | 1.186 | 0.199 | 0.761 | 0.107 | 1.131 | 0.325 | 1.203 | 0.267 |
| Group 2 (0.25 mg/kg AD05891) | 1.056 | 0.104 | 0.947 | 0.161 | N/A | N/A | N/A | N/A |
| Group 3 (0.25 mg/kg AD05892) | 0.860 | 0.111 | 0.856 | 0.142 | N/A | N/A | N/A | N/A |
| Group 4 (0.25 mg/kg AD05893) | 1.132 | 0.037 | 1.137 | 0.163 | N/A | N/A | N/A | N/A |
| Group 5 (0.25 mg/kg AD05894) | 0.776 | 0.145 | 0.795 | 0.144 | N/A | N/A | N/A | N/A |
| Group 6 (0.25 mg/kg AD05895) | 0.852 | 0.275 | 0.808 | 0.220 | N/A | N/A | N/A | N/A |
| Group 7 (0.25 mg/kg AD05896) | 0.995 | 0.080 | 0.943 | 0.114 | N/A | N/A | N/A | N/A |
| Group 8 (0.25 mg/kg AD05897) | 0.978 | 0.160 | 1.015 | 0.136 | N/A | N/A | N/A | N/A |
| Group 9 (0.25 mg/kg AD05889) | 1.094 | 0.205 | 1.018 | 0.166 | N/A | N/A | N/A | N/A |
| Group 10 (0.25 mg/kg AD05890) | 1.032 | 0.055 | 1.015 | 0.196 | N/A | N/A | N/A | N/A |
| Group 11 (0.25 mg/kg AD05876) | 0.573 | 0.180 | 0.565 | 0.117 | 0.657 | 0.107 | 0.782 | 0.052 |
| Group 12 (0.25 mg/kg AD05877) | 0.673 | 0.141 | 0.595 | 0.156 | 0.688 | 0.235 | N/A | N/A |
| Group 13 (0.25 mg/kg AD05878) | 0.598 | 0.231 | 0.609 | 0.227 | 0.689 | 0.293 | N/A | N/A |
| Group 14 (0.25 mg/kg AD05879) | 0.705 | 0.052 | 0.655 | 0.041 | 0.848 | 0.111 | N/A | N/A |
| Group 15 (0.25 mg/kg AD05880) | 0.596 | 0.230 | 0.635 | 0.235 | N/A | N/A | N/A | N/A |
| Group 16 (0.25 mg/kg AD05882) | 1.169 | 0.241 | 1.268 | 0.327 | N/A | N/A | N/A | N/A |
| Group 17 (0.25 mg/kg AD05884) | 0.597 | 0.290 | 0.574 | 0.254 | 0.668 | 0.284 | N/A | N/A |
| Group 18 (0.25 mg/kg AD05885) | 0.765 | 0.192 | 0.837 | 0.089 | N/A | N/A | N/A | N/A |
| Group 19 (0.25 mg/kg AD05886) | 1.043 | 0.285 | 1.336 | 0.497 | N/A | N/A | N/A | N/A |

TABLE 30-continued

Average Total Cholesterol Normalized to Pre-Dose from Example 10.

| Group ID | Day 8 Avg Total Chol | Day 8 Std Dev (+/−) | Day 15 Avg Total Chol | Day 15 Std Dev (+/−) | Day 22 Avg Total Chol | Day 22 Std Dev (+/−) | Day 29 Avg Total Chol | Day 29 Std Dev (+/−) |
|---|---|---|---|---|---|---|---|---|
| Group 20 (0.25 mg/kg AD05887) | 0.679 | 0.087 | 0.843 | 0.174 | N/A | N/A | N/A | N/A |
| Group 21 (0.25 mg/kg AD05888) | 0.674 | 0.292 | 0.807 | 0.302 | N/A | N/A | N/A | N/A |
| Group 22 (0.25 mg/kg AD05769) | 0.479 | 0.094 | 0.551 | 0.122 | 0.537 | 0.075 | 0.583 | 0.125 |

TABLE 31

Average HDL Normalized to Pre-Dose from Example 10.

| Group ID | Day 8 Avg HDL | Day 8 Std Dev (+/−) | Day 15 Avg HDL | Day 15 Std Dev (+/−) | Day 22 Avg HDL | Day 22 Std Dev (+/−) | Day 29 Avg HDL | Day 29 Std Dev (+/−) |
|---|---|---|---|---|---|---|---|---|
| Group 1 (D5W) | 0.837 | 0.062 | 0.761 | 0.079 | 0.697 | 0.019 | 0.910 | 0.079 |
| Group 2 (0.25 mg/kg AD05891) | 0.668 | 0.206 | 0.809 | 0.267 | N/A | N/A | N/A | N/A |
| Group 3 (0.25 mg/kg AD05892) | 0.612 | 0.231 | 0.833 | 0.182 | N/A | N/A | N/A | N/A |
| Group 4 (0.25 mg/kg AD05893) | 0.779 | 0.343 | 0.820 | 0.331 | N/A | N/A | N/A | N/A |
| Group 5 (0.25 mg/kg AD05894) | 0.856 | 0.148 | 0.942 | 0.212 | N/A | N/A | N/A | N/A |
| Group 6 (0.25 mg/kg AD05895) | 1.235 | 0.117 | 1.241 | 0.079 | N/A | N/A | N/A | N/A |
| Group 7 (0.25 mg/kg AD05896) | 1.279 | 0.792 | 1.248 | 0.740 | N/A | N/A | N/A | N/A |
| Group 8 (0.25 mg/kg AD05897) | 1.122 | 0.285 | 0.992 | 0.298 | N/A | N/A | N/A | N/A |
| Group 9 (0.25 mg/kg AD05889) | 0.783 | 0.278 | 0.718 | 0.203 | N/A | N/A | N/A | N/A |
| Group 10 (0.25 mg/kg AD05890) | 0.885 | 0.294 | 0.661 | 0.131 | N/A | N/A | N/A | N/A |
| Group 11 (0.25 mg/kg AD05876) | 2.059 | 0.818 | 1.747 | 0.597 | 1.981 | 0.319 | 1.748 | 0.825 |
| Group 12 (0.25 mg/kg AD05877) | 1.317 | 0.148 | 1.295 | 0.273 | 1.176 | 0.130 | N/A | N/A |
| Group 13 (0.25 mg/kg AD05878) | 1.421 | 0.294 | 1.273 | 0.262 | 0.999 | 0.328 | N/A | N/A |
| Group 14 (0.25 mg/kg AD05879) | 1.037 | 0.074 | 0.945 | 0.125 | 0.924 | 0.141 | N/A | N/A |
| Group 15 (0.25 mg/kg AD05880) | 0.905 | 0.266 | 0.855 | 0.051 | N/A | N/A | N/A | N/A |
| Group 16 (0.25 mg/kg AD05882) | 0.784 | 0.098 | 0.621 | 0.103 | N/A | N/A | N/A | N/A |
| Group 17 (0.25 mg/kg AD05884) | 1.529 | 0.486 | 1.228 | 0.309 | 1.149 | 0.257 | N/A | N/A |
| Group 18 (0.25 mg/kg AD05885) | 1.123 | 0.323 | 0.651 | 0.143 | N/A | N/A | N/A | N/A |
| Group 19 (0.25 mg/kg AD05886) | 1.047 | 0.343 | 0.675 | 0.181 | N/A | N/A | N/A | N/A |
| Group 20 (0.25 mg/kg AD05887) | 2.093 | 1.089 | 1.487 | 0.748 | N/A | N/A | N/A | N/A |
| Group 21 (0.25 mg/kg AD05888) | 1.452 | 0.065 | 1.245 | 0.177 | N/A | N/A | N/A | N/A |
| Group 22 (0.25 mg/kg AD05769) | 1.289 | 0.219 | 1.186 | 0.202 | 1.125 | 0.231 | 1.325 | 0.044 |

TABLE 32

Average LDL Normalized to Pre-Dose from Example 10.

| Group ID | Day 8 Avg LDL | Day 8 Std Dev (+/−) | Day 15 Avg LDL | Day 15 Std Dev (+/−) | Day 22 Avg LDL | Day 22 Std Dev (+/−) | Day 29 Avg LDL | Day 29 Std Dev (+/−) |
|---|---|---|---|---|---|---|---|---|
| Group 1 (D5W) | 1.456 | 0.391 | 1.107 | 0.243 | 1.506 | 0.751 | 1.568 | 0.650 |
| Group 2 (0.25 mg/kg AD05891) | 1.417 | 0.351 | 1.593 | 0.488 | N/A | N/A | N/A | N/A |
| Group 3 (0.25 mg/kg AD05892) | 0.875 | 0.398 | 0.951 | 0.170 | N/A | N/A | N/A | N/A |
| Group 4 (0.25 mg/kg AD05893) | 1.243 | 0.217 | 1.400 | 0.311 | N/A | N/A | N/A | N/A |
| Group 5 (0.25 mg/kg AD05894) | 0.776 | 0.175 | 0.934 | 0.244 | N/A | N/A | N/A | N/A |
| Group 6 (0.25 mg/kg AD05895) | 1.223 | 0.413 | 1.208 | 0.361 | N/A | N/A | N/A | N/A |
| Group 7 (0.25 mg/kg AD05896) | 1.347 | 0.475 | 1.224 | 0.331 | N/A | N/A | N/A | N/A |
| Group 8 (0.25 mg/kg AD05897) | 1.206 | 0.398 | 1.255 | 0.137 | N/A | N/A | N/A | N/A |
| Group 9 (0.25 mg/kg AD05889) | 1.291 | 0.294 | 1.329 | 0.267 | N/A | N/A | N/A | N/A |
| Group 10 (0.25 mg/kg AD05890) | 1.171 | 0.363 | 1.091 | 0.284 | N/A | N/A | N/A | N/A |
| Group 11 (0.25 mg/kg AD05876) | 0.679 | 0.457 | 0.703 | 0.329 | 0.881 | 0.237 | 0.896 | 0.252 |
| Group 12 (0.25 mg/kg AD05877) | 0.575 | 0.162 | 0.531 | 0.187 | 0.624 | 0.304 | N/A | N/A |
| Group 13 (0.25 mg/kg AD05878) | 0.534 | 0.191 | 0.532 | 0.163 | 0.666 | 0.321 | N/A | N/A |
| Group 14 (0.25 mg/kg AD05879) | 0.602 | 0.043 | 0.671 | 0.060 | 0.939 | 0.171 | N/A | N/A |
| Group 15 (0.25 mg/kg AD05880) | 0.527 | 0.098 | 0.525 | 0.122 | N/A | N/A | N/A | N/A |
| Group 16 (0.25 mg/kg AD05882) | 1.252 | 0.279 | 1.568 | 0.525 | N/A | N/A | N/A | N/A |
| Group 17 (0.25 mg/kg AD05884) | 0.814 | 0.591 | 0.590 | 0.363 | 0.850 | 0.453 | N/A | N/A |
| Group 18 (0.25 mg/kg AD05885) | 0.827 | 0.171 | 0.798 | 0.043 | N/A | N/A | N/A | N/A |
| Group 19 (0.25 mg/kg AD05886) | 1.045 | 0.206 | 1.180 | 0.134 | N/A | N/A | N/A | N/A |
| Group 20 (0.25 mg/kg AD05887) | 0.756 | 0.118 | 0.794 | 0.156 | N/A | N/A | N/A | N/A |
| Group 21 (0.25 mg/kg AD05888) | 0.745 | 0.460 | 0.945 | 0.499 | N/A | N/A | N/A | N/A |
| Group 22 (0.25 mg/kg AD05769) | 0.634 | 0.293 | 0.568 | 0.243 | 0.625 | 0.189 | 0.644 | 0.136 |

As shown in Tables 28-32 above, the RNAi agents in Groups 2 through 10 (i.e., RNAi agents with antisense strands designed to target an APOC3 gene at positions 248, 263, 422, 246, and 168) showed relatively limited inhibitory effect, particularly when compared to the RNAi agents in Groups 11 through 22, which all included antisense strand nucleotide sequences designed to target position 438 of an APOC3 gene. Further, of those RNAi agents that included sequences targeting position 438 of the APOC3 gene, Group 11 (AD05876) and Group 22 (AD05769) showed the greatest level of inhibitory effect with respect to APOC3 protein levels, triglycerides, and total cholesterol levels.

Example 11. In Vivo Testing of APOC3 RNAi Agents in APOC3 Transgenic Mice

The APOC3 Transgenic Mouse Model described in Example 5, above, was used. At day 1, each mouse was given a single subcutaneous administration of 200 µl of the respective RNAi agent dissolved in D5W (dextrose in 5% water) or control vehicle (D5W) according to the dosing groups shown in the following Table 33:

TABLE 33

Dosing groups of Example 11.

| Group | RNAi Agent and Dose | Dosing Regimen |
|---|---|---|
| 1 | D5W (no RNAi agent) | Single injection on day 1 |
| 2 | 0.5 mg/kg AD05260 | Single injection on day 1 |
| 3 | 0.5 mg/kg AD05221 | Single injection on day 1 |
| 4 | 0.5 mg/kg AD05223 | Single injection on day 1 |
| 5 | 0.5 mg/kg AD05299 | Single injection on day 1 |
| 6 | 0.5 mg/kg AD05283 | Single injection on day 1 |
| 7 | 0.5 mg/kg AD05284 | Single injection on day 1 |
| 8 | 0.5 mg/kg AD05167 | Single injection on day 1 |
| 9 | 0.5 mg/kg AD05168 | Single injection on day 1 |
| 10 | 0.5 mg/kg AD05171 | Single injection on day 1 |
| 11 | 0.5 mg/kg AD05258 | Single injection on day 1 |
| 12 | 0.5 mg/kg AD05259 | Single injection on day 1 |
| 13 | 0.5 mg/kg AD05169 | Single injection on day 1 |
| 14 | 0.5 mg/kg AD05239 | Single injection on day 1 |
| 15 | 0.5 mg/kg AD05251 | Single injection on day 1 |
| 16 | 0.5 mg/kg AD05220 | Single injection on day 1 |

Each of the APOC3 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 4, 5, 6, and 7 for specific modifications and structure information related to the APOC3 RNAi agents).

The APOC3 RNAi agents tested in Example 11 included nucleotide sequences that were designed to target different positions on the APOC3 gene (i.e., SEQ ID NO:1). More specifically, Group 2 (i.e., APOC3 RNAi agent AD05260) included an antisense strand sequence designed to target position 58 of an APOC3 gene; Group 3 (i.e., APOC3 RNAi agent AD05221) included an antisense strand sequence designed to target position 246 of an APOC3 gene; Groups 4-7 (i.e., APOC3 RNAi agents AD05223, AD05299, AD05283, and AD05284) included antisense strand sequences designed to target position 432 of an APOC3 gene; Groups 8-12 (i.e., APOC3 RNAi agents AD05167, AD05168, AD05171, AD05258, and AD05259) included antisense strand sequences designed to target position 434 of an APOC3 gene; Groups 13-15 (i.e., APOC3 RNAi agents AD05169, AD05239, and AD05251) included antisense strand sequences designed to target position 438 of an APOC3 gene; and Group 16 (i.e., APOC3 RNAi agent AD05220) included an antisense strand sequence designed to target position 506 of an APOC3 gene.

The injections were performed between the skin and muscle (i.e. subcutaneous injections) into the loose skin over the neck and shoulder area. Three (3) mice in each Group were tested (n=3). Serum was collected on day −1 (pre-dose bleed with a 4 hour fast), and days 8, 15. For mice dosed with the certain RNAi agents that exhibited relatively high inhibitory activity and for the mice dosed with the vehicle control, additional serum samples were collected on days 22 and 29. Mice were fasted for four hours prior to each collection. APOC3 expression levels, triglycerides, high-density lipoprotein (HDL), low-density lipoprotein (LDL), and total cholesterol in serum were measured on a Cobas® Integra 400 (Roche Diagnostics), according to the manufacturer's recommendations.

The APOC3 protein levels, triglyceride levels, HDL levels, and total cholesterol levels for each animal were normalized. For normalization, the level of APOC3 protein, triglyceride, HDL, LDL, and total cholesterol, respectively, for each animal at a time point, was divided by the pre-treatment level of expression in that animal (in this case at day −1) to determine the ratio of expression "normalized to pre-dose." Data from the experiment are shown in the following Tables 34 through 38:

TABLE 34

Average APOC3 Protein Normalized to Pre-Dose from Example 11.

| | Day 8 | | Day 15 | | Day 22 | | Day 29 | |
|---|---|---|---|---|---|---|---|---|
| Group ID | Avg APOC3 | Std Dev (+/−) | Avg APOC3 | Std Dev (+/−) | Avg APOC3 | Std Dev (+/−) | Avg APOC3 | Std Dev (+/−) |
| Group 1 (D5W) | 0.854 | 0.102 | 0.866 | 0.140 | 0.881 | 0.079 | 0.857 | 0.140 |
| Group 2 (0.5 mg/kg AD05260) | 0.297 | 0.031 | 0.352 | 0.042 | N/A | N/A | N/A | N/A |
| Group 3 (0.5 mg/kg AD05221) | 0.483 | 0.060 | 0.619 | 0.046 | N/A | N/A | N/A | N/A |
| Group 4 (0.5 mg/kg AD05223) | 0.123 | 0.048 | 0.242 | 0.101 | 0.311 | 0.099 | 0.424 | 0.152 |
| Group 5 (0.5 mg/kg AD05299) | 0.272 | 0.047 | 0.589 | 0.016 | N/A | N/A | N/A | N/A |
| Group 6 (0.5 mg/kg AD05283) | 0.108 | 0.014 | 0.121 | 0.011 | 0.163 | 0.009 | 0.201 | 0.032 |
| Group 7 (0.5 mg/kg AD05284) | 0.174 | 0.111 | 0.208 | 0.123 | 0.313 | 0.124 | 0.405 | 0.144 |
| Group 8 (0.5 mg/kg AD05167) | 0.466 | 0.093 | 0.656 | 0.286 | N/A | N/A | N/A | N/A |
| Group 9 (0.5 mg/kg AD05168) | 0.146 | 0.046 | 0.452 | 0.098 | N/A | N/A | N/A | N/A |
| Group 10 (0.5 mg/kg AD05171) | 0.191 | 0.088 | 0.199 | 0.095 | 0.419 | 0.070 | 0.548 | 0.087 |
| Group 11 (0.5 mg/kg AD05258) | 0.545 | 0.147 | 0.624 | 0.142 | N/A | N/A | N/A | N/A |
| Group 12 (0.5 mg/kg AD05259) | 0.236 | 0.047 | 0.300 | 0.115 | N/A | N/A | N/A | N/A |
| Group 13 (0.5 mg/kg AD05169) | 0.643 | 0.172 | 0.613 | 0.161 | N/A | N/A | N/A | N/A |
| Group 14 (0.5 mg/kg AD05239) | 0.438 | 0.065 | 0.542 | 0.014 | N/A | N/A | N/A | N/A |

TABLE 34-continued

Average APOC3 Protein Normalized to Pre-Dose from Example 11.

| Group ID | Day 8 | | Day 15 | | Day 22 | | Day 29 | |
|---|---|---|---|---|---|---|---|---|
| | Avg APOC3 | Std Dev (+/−) | Avg APOC3 | Std Dev (+/−) | Avg APOC3 | Std Dev (+/−) | Avg APOC3 | Std Dev (+/−) |
| Group 15 (0.5 mg/kg AD05251) | 0.125 | 0.013 | 0.132 | 0.037 | 0.157 | 0.033 | 0.188 | 0.049 |
| Group 16 (0.5 mg/kg AD05220) | 0.211 | 0.012 | 0.201 | 0.087 | 0.230 | 0.045 | 0.342 | 0.166 |

TABLE 35

Average Triglycerides Normalized to Pre-Dose from Example 11.

| Group ID | Day 8 | | Day 15 | | Day 22 | | Day 29 | |
|---|---|---|---|---|---|---|---|---|
| | Avg TG | Std Dev (+/−) | Avg TG | Std Dev (+/−) | Avg TG | Std Dev (+/−) | Avg TG | Std Dev (+/−) |
| Group 1 (D5W) | 0.939 | 0.217 | 0.835 | 0.235 | 0.965 | 0.215 | 1.051 | 0.136 |
| Group 2 (0.5 mg/kg AD05260) | 0.259 | 0.085 | 0.324 | 0.124 | N/A | N/A | N/A | N/A |
| Group 3 (0.5 mg/kg AD05221) | 0.352 | 0.134 | 0.481 | 0.077 | N/A | N/A | N/A | N/A |
| Group 4 (0.5 mg/kg AD05223) | 0.133 | 0.034 | 0.228 | 0.057 | 0.327 | 0.060 | 0.451 | 0.105 |
| Group 5 (0.5 mg/kg AD05299) | 0.352 | 0.134 | 0.481 | 0.086 | N/A | N/A | N/A | N/A |
| Group 6 (0.5 mg/kg AD05283) | 0.130 | 0.022 | 0.150 | 0.026 | 0.245 | 0.056 | 0.286 | 0.023 |
| Group 7 (0.5 mg/kg AD05284) | 0.203 | 0.162 | 0.275 | 0.231 | 0.350 | 0.199 | 0.477 | 0.260 |
| Group 8 (0.5 mg/kg AD05167) | 0.318 | 0.126 | 0.483 | 0.330 | N/A | N/A | N/A | N/A |
| Group 9 (0.5 mg/kg AD05168) | 0.188 | 0.014 | 0.330 | 0.010 | N/A | N/A | N/A | N/A |
| Group 10 (0.5 mg/kg AD05171) | 0.183 | 0.092 | 0.282 | 0.150 | 0.423 | 0.124 | 0.549 | 0.138 |
| Group 11 (0.5 mg/kg AD05258) | 0.479 | 0.167 | 0.622 | 0.187 | N/A | N/A | N/A | N/A |
| Group 12 (0.5 mg/kg AD05259) | 0.294 | 0.015 | 0.360 | 0.190 | N/A | N/A | N/A | N/A |
| Group 13 (0.5 mg/kg AD05169) | 0.728 | 0.253 | 0.561 | 0.163 | N/A | N/A | N/A | N/A |
| Group 14 (0.5 mg/kg AD05239) | 0.381 | 0.038 | 0.422 | 0.057 | N/A | N/A | N/A | N/A |
| Group 15 (0.5 mg/kg AD05251) | 0.110 | 0.032 | 0.092 | 0.019 | 0.134 | 0.051 | 0.186 | 0.072 |
| Group 16 (0.5 mg/kg AD05220) | 0.161 | 0.045 | 0.216 | 0.029 | 0.184 | 0.075 | 0.358 | 0.141 |

TABLE 36

Average Total Cholesterol Normalized to Pre-Dose from Example 11.

| Group ID | Day 8 | | Day 15 | | Day 22 | | Day 29 | |
|---|---|---|---|---|---|---|---|---|
| | Avg Total Chol | Std Dev (+/−) | Avg Total Chol | Std Dev (+/−) | Avg Total Chol | Std Dev (+/−) | Avg Total Chol | Std Dev (+/−) |
| Group 1 (D5W) | 0.769 | 0.127 | 0.684 | 0.182 | 0.835 | 0.167 | 0.796 | 0.180 |
| Group 2 (0.5 mg/kg AD05260) | 0.320 | 0.081 | 0.367 | 0.072 | N/A | N/A | N/A | N/A |
| Group 3 (0.5 mg/kg AD05221) | 0.397 | 0.078 | 0.456 | 0.050 | N/A | N/A | N/A | N/A |
| Group 4 (0.5 mg/kg AD05223) | 0.393 | 0.176 | 0.450 | 0.189 | 0.476 | 0.186 | 0.606 | 0.193 |
| Group 5 (0.5 mg/kg AD05299) | 0.522 | 0.092 | 0.611 | 0.031 | N/A | N/A | N/A | N/A |
| Group 6 (0.5 mg/kg AD05283) | 0.413 | 0.058 | 0.372 | 0.053 | 0.450 | 0.100 | 0.501 | 0.040 |
| Group 7 (0.5 mg/kg AD05284) | 0.430 | 0.270 | 0.444 | 0.241 | 0.519 | 0.252 | 0.604 | 0.315 |
| Group 8 (0.5 mg/kg AD05167) | 0.464 | 0.231 | 0.557 | 0.382 | N/A | N/A | N/A | N/A |
| Group 9 (0.5 mg/kg AD05168) | 0.298 | 0.034 | 0.388 | 0.012 | N/A | N/A | N/A | N/A |
| Group 10 (0.5 mg/kg AD05171) | 0.360 | 0.179 | 0.391 | 0.180 | 0.473 | 0.147 | 0.538 | 0.141 |
| Group 11 (0.5 mg/kg AD05258) | 0.619 | 0.094 | 0.668 | 0.135 | N/A | N/A | N/A | N/A |
| Group 12 (0.5 mg/kg AD05259) | 0.643 | 0.053 | 0.511 | 0.187 | N/A | N/A | N/A | N/A |
| Group 13 (0.5 mg/kg AD05169) | 0.731 | 0.089 | 0.636 | 0.013 | N/A | N/A | N/A | N/A |
| Group 14 (0.5 mg/kg AD05239) | 0.571 | 0.106 | 0.561 | 0.085 | N/A | N/A | N/A | N/A |
| Group 15 (0.5 mg/kg AD05251) | 0.248 | 0.065 | 0.287 | 0.147 | 0.260 | 0.074 | 0.305 | 0.114 |
| Group 16 (0.5 mg/kg AD05220) | 0.400 | 0.081 | 0.438 | 0.048 | 0.422 | 0.065 | 0.524 | 0.080 |

TABLE 37

Average HDL Normalized to Pre-Dose from Example 11.

| Group ID | Day 8 Avg HDL | Day 8 Std Dev (+/−) | Day 15 Avg HDL | Day 15 Std Dev (+/−) | Day 22 Avg HDL | Day 22 Std Dev (+/−) | Day 29 Avg HDL | Day 29 Std Dev (+/−) |
|---|---|---|---|---|---|---|---|---|
| Group 1 (D5W) | 0.825 | 0.119 | 0.893 | 0.217 | 0.912 | 0.179 | 0.886 | 0.262 |
| Group 2 (0.5 mg/kg AD05260) | 1.356 | 0.337 | 1.331 | 0.435 | N/A | N/A | N/A | N/A |
| Group 3 (0.5 mg/kg AD05221) | 1.483 | 0.266 | 0.953 | 0.166 | N/A | N/A | N/A | N/A |
| Group 4 (0.5 mg/kg AD05223) | 1.058 | 0.198 | 1.032 | 0.300 | 0.856 | 0.209 | 0.868 | 0.349 |
| Group 5 (0.5 mg/kg AD05299) | 1.456 | 0.345 | 1.137 | 0.460 | N/A | N/A | N/A | N/A |
| Group 6 (0.5 mg/kg AD05283) | 2.494 | 0.174 | 2.150 | 0.465 | 1.731 | 0.397 | 1.738 | 0.156 |
| Group 7 (0.5 mg/kg AD05284) | 1.559 | 0.237 | 1.791 | 0.849 | 1.598 | 0.448 | 1.605 | 0.131 |
| Group 8 (0.5 mg/kg AD05167) | 1.239 | 0.287 | 1.310 | 0.108 | N/A | N/A | N/A | N/A |
| Group 9 (0.5 mg/kg AD05168) | 1.666 | 0.551 | 1.425 | 0.251 | N/A | N/A | N/A | N/A |
| Group 10 (0.5 mg/kg AD05171) | 1.514 | 0.286 | 1.435 | 0.248 | 0.941 | 0.005 | 0.827 | 0.111 |
| Group 11 (0.5 mg/kg AD05258) | 1.170 | 0.082 | 1.081 | 0.212 | N/A | N/A | N/A | N/A |
| Group 12 (0.5 mg/kg AD05259) | 1.964 | 0.955 | 1.221 | 0.228 | N/A | N/A | N/A | N/A |
| Group 13 (0.5 mg/kg AD05169) | 1.059 | 0.236 | 1.101 | 0.230 | N/A | N/A | N/A | N/A |
| Group 14 (0.5 mg/kg AD05239) | 1.323 | 0.088 | 1.120 | 0.224 | N/A | N/A | N/A | N/A |
| Group 15 (0.5 mg/kg AD05251) | 1.728 | 0.173 | 2.143 | 0.688 | 1.632 | 0.312 | 1.737 | 0.452 |
| Group 16 (0.5 mg/kg AD05220) | 1.660 | 0.391 | 1.797 | 0.384 | 1.803 | 0.637 | 1.479 | 0.333 |

TABLE 38

Average LDL Normalized to Pre-Dose from Example 11.

| Group ID | Day 8 Avg LDL | Day 8 Std Dev (+/−) | Day 15 Avg LDL | Day 15 Std Dev (+/−) | Day 22 Avg LDL | Day 22 Std Dev (+/−) | Day 29 Avg LDL | Day 29 Std Dev (+/−) |
|---|---|---|---|---|---|---|---|---|
| Group 1 (D5W) | 0.699 | 0.129 | 0.621 | 0.201 | 0.778 | 0.259 | 0.646 | 0.216 |
| Group 2 (0.5 mg/kg AD05260) | 0.398 | 0.108 | 0.317 | 0.046 | N/A | N/A | N/A | N/A |
| Group 3 (0.5 mg/kg AD05221) | 0.441 | 0.024 | 0.422 | 0.013 | N/A | N/A | N/A | N/A |
| Group 4 (0.5 mg/kg AD05223) | 0.441 | 0.280 | 0.437 | 0.219 | 0.514 | 0.264 | 0.589 | 0.219 |
| Group 5 (0.5 mg/kg AD05299) | 0.504 | 0.160 | 0.577 | 0.100 | N/A | N/A | N/A | N/A |
| Group 6 (0.5 mg/kg AD05283) | 0.464 | 0.122 | 0.428 | 0.173 | 0.551 | 0.277 | 0.595 | 0.195 |
| Group 7 (0.5 mg/kg AD05284) | 0.394 | 0.258 | 0.404 | 0.179 | 0.398 | 0.214 | 0.471 | 0.290 |
| Group 8 (0.5 mg/kg AD05167) | 0.572 | 0.306 | 0.678 | 0.536 | N/A | N/A | N/A | N/A |
| Group 9 (0.5 mg/kg AD05168) | 0.329 | 0.067 | 0.374 | 0.017 | N/A | N/A | N/A | N/A |
| Group 10 (0.5 mg/kg AD05171) | 0.303 | 0.186 | 0.280 | 0.134 | 0.401 | 0.113 | 0.429 | 0.180 |
| Group 11 (0.5 mg/kg AD05258) | 0.669 | 0.105 | 0.702 | 0.140 | N/A | N/A | N/A | N/A |
| Group 12 (0.5 mg/kg AD05259) | 0.588 | 0.208 | 0.407 | 0.211 | N/A | N/A | N/A | N/A |
| Group 13 (0.5 mg/kg AD05169) | 0.626 | 0.116 | 0.672 | 0.057 | N/A | N/A | N/A | N/A |
| Group 14 (0.5 mg/kg AD05239) | 0.473 | 0.138 | 0.488 | 0.124 | N/A | N/A | N/A | N/A |
| Group 15 (0.5 mg/kg AD05251) | 0.254 | 0.147 | 0.344 | 0.257 | 0.234 | 0.063 | 0.306 | 0.166 |
| Group 16 (0.5 mg/kg AD05220) | 0.364 | 0.043 | 0.439 | 0.045 | 0.461 | 0.157 | 0.455 | 0.101 |

Example 12. In Vivo Testing of APOC3 RNAi Agents in Cynomolgus Monkeys

APOC3 RNAi agents were evaluated in cynomolgus monkeys. On day 1, cynomolgus macaque (*Macaca fascicularis*) primates (also referred to herein as "cynos") were administered a single subcutaneous injection of 0.3 mL/kg (approximately 2-3 mL volume, depending on animal mass) containing 3.0 mg/kg of APOC3 RNAi agent AD05876, formulated in saline. APOC3 RNAi agent AD05876 included modified nucleotides and a tridentate N-acetyl-galactosamine targeting ligand ((NAG37)s) conjugated to the 5'-terminal end of the sense strand, as shown in Tables 4, 5, 6, and 7.

Two (2) cynos were tested (n=2). On days −8 (pre-dose), 29, and 50, liver biopsies were taken. For one of the monkeys, additional liver biopsy samples were taken on day 15. On the date of each biopsy collection, cynos were anesthetized and ultrasound-guided liver biopsies were performed to extract two or three liver tissue samples approximately 1 mm×4 mm in size. The biopsy samples were then homogenized, and levels of APOC3 mRNA in the cyno livers were measured by RT-qPCR. Resulting values were then normalized to the pre-dose (in this case, at day −8) APOC3 mRNA measurements. The resulting mRNA data is reflected in the following Tables 39 and 40:

TABLE 39

APOC3 mRNA Levels Normalized to Pre-Dose from Example 12 of Cyno #1 (cy0713).

| Relative APOC3 mRNA Expression | Low Error | High Error |
|---|---|---|
| Day 29 | | |
| 0.125 | 0.003 | 0.003 |
| Day 50 | | |
| 0.167 | 0.002 | 0.002 |

TABLE 40

APOC3 mRNA Levels Normalized to Pre-Dose from Example 12 of Cyno #2 (cy0716).

| Relative APOC3 mRNA Expression | Low Error | High Error |
|---|---|---|
| Day 15 | | |
| 0.250 | 0.007 | 0.007 |
| Day 29 | | |
| 0.112 | 0.005 | 0.00 |
| Day 50 | | |
| 0.239 | 0.003 | 0.003 |

Both of the cynos dosed with AD05876 showed a significant reduction in liver-specific APOC3 mRNA compared to pre-treatment measurements at all measured time points. On day 29, for example, the first cyno had a reduction of APOC3 mRNA of approximately 87.5% (0.125), while the second cyno had a reduction of approximately 88.8% (0.112), compared to pre-dose levels.

Example 13. In Vivo Testing of APOC3 RNAi Agents in High Fructose Corn Syrup (HFCS) Diet-Fed Rhesus Monkeys APOC3 RNAi agent AD05876 was further evaluated in high-fructose corn syrup (HFCS) diet-fed Rhesus monkeys. Rhesus monkeys were placed on an HFCS diet 37 days prior to dosing. These animals were known to develop increased plasma triglycerides greater than 180 mg/dL on the HFCS diet. On day 1 and again on day 29, four (4) Rhesus monkeys were administered a subcutaneous injection containing 4.0 mg/kg of APOC3 RNAi agent AD05876 formulated in saline (n=4). Two additional Rhesus monkeys were administered normal saline control. APOC3 RNAi agent AD05876 contained modified nucleotides and included N-acetyl-galactosamine targeting ligands conjugated to the 5'-terminal end of the sense strand, as shown in Tables 4, 5, 6, and 7.

Both fed and fasting blood samples were drawn for analysis, and fasting serum samples were analyzed on days −8 (predose), 8, and 15. Monkeys were fasted overnight prior to each collection. APOC3 protein levels in serum were measured by ELISA assay (R&D Systems), according to the manufacturer's recommendations. Triglycerides, total cholesterol, high-density lipoprotein (HDL), and low-density lipoprotein (LDL) in serum were measured on a Cobas® Integra 400 (Roche Diagnostics), according to the manufacturer's recommendations.

The APOC3 protein levels, triglyceride levels, total cholesterol levels, HDL levels, and LDL levels for each animal were normalized. For normalization, the level of APCO3 protein, triglyceride, HDL, and total cholesterol, respectively, for each animal at a time point, was divided by the pre-treatment level of expression in that animal (in this case at day −8) to determine the ratio of expression "normalized to pre-treatment."

Data from the study set forth in this Example are shown in the following Tables 41-45:

TABLE 41

Average APOC3 Protein Normalized to Pre-Treatment from Example 13 (Fasted)

| Group ID | Day 8 | | Day 15 | | Day 21 | | Day 29 | | Day 36 | |
|---|---|---|---|---|---|---|---|---|---|---|
| | Avg APOC3 | Std Dev (+/−) | Avg APOC3 | Std Dev (+/−) | Avg APOC3 | Std Dev (+/−) | Avg APOC3 | Std Dev (+/−) | Avg APOC3 | Std Dev (+/−) |
| Group 1 (saline control) | 0.921 | 0.007 | 0.902 | 0.009 | 0.922 | 0.026 | 0.905 | 0.025 | 0.922 | 0.006 |
| Group 2 (4.0 mg/kg AD05876) | 0.509 | 0.150 | 0.388 | 0.159 | 0.347 | 0.114 | 0.358 | 0.086 | 0.335 | 0.100 |

TABLE 42

Average TG Normalized to Pre-Treatment from Example 13 (Fasted)

| Group ID | Day 8 | | Day 15 | | Day 21 | | Day 29 | | Day 36 | |
|---|---|---|---|---|---|---|---|---|---|---|
| | Avg TG | Std Dev (+/−) | Avg TG | Std Dev (+/−) | Avg TG | Std Dev (+/−) | Avg TG | Std Dev (+/−) | Avg TG | Std Dev (+/−) |
| Group 1 (saline control) | 0.743 | 0.055 | 0.717 | 0.054 | 1.017 | 0.155 | 0.758 | 0.263 | 0.659 | 0.111 |
| Group 2 (4.0 mg/kg AD05876) | 0.599 | 0.338 | 0.433 | 0.286 | 0.395 | 0.247 | 0.435 | 0.212 | 0.408 | 0.269 |

TABLE 43

Average Total Cholesterol Normalized to Pre-Treatment from Example 13 (Fasted)

| Group ID | Day 8 | | Day 15 | | Day 21 | | Day 29 | | Day 36 | |
|---|---|---|---|---|---|---|---|---|---|---|
| | Avg Total Chol | Std Dev (+/−) | Avg Total Chol | Std Dev (+/−) | Avg Total Chol | Std Dev (+/−) | Avg Total Chol | Std Dev (+/−) | Avg Total Chol | Std Dev (+/−) |
| Group 1 (saline control) | 0.972 | 0.050 | 0.944 | 0.079 | 0.957 | 0.0.18 | 0.882 | 0.021 | 0.894 | 0.038 |

TABLE 43-continued

Average Total Cholesterol Normalized to Pre-Treatment from Example 13 (Fasted)

| | Day 8 | | Day 15 | | Day 21 | | Day 29 | | Day 36 | |
| --- | --- | --- | --- | --- | --- | --- | --- | --- | --- | --- |
| Group ID | Avg Total Chol | Std Dev (+/−) | Avg Total Chol | Std Dev (+/−) | Avg Total Chol | Std Dev (+/−) | Avg Total Chol | Std Dev (+/−) | Avg Total Chol | Std Dev (+/−) |
| Group 2 (4.0 mg/kg AD05876) | 0.860 | 0.177 | 0.826 | 0.1119 | 0.825 | 0.084 | 0.780 | 0.162 | 0.751 | 0.203 |

TABLE 44

Average HDL Normalized to Pre-Treatment from Example 13 (Fasted)

| | Day 8 | | Day 15 | | Day 21 | | Day 29 | | Day 36 | |
| --- | --- | --- | --- | --- | --- | --- | --- | --- | --- | --- |
| Group ID | Avg Total Chol | Std Dev (+/−) | Avg Total Chol | Std Dev (+/−) | Avg Total Chol | Std Dev (+/−) | Avg Total Chol | Std Dev (+/−) | Avg Total Chol | Std Dev (+/−) |
| Group 1 (saline control) | 1.082 | 0.098 | 1.071 | 0.111 | 1.003 | 0.158 | 1.025 | 0.131 | 1.027 | 0.071 |
| Group 2 (4.0 mg/kg AD05876) | 1.370 | 0.267 | 1.445 | 0.479 | 1.465 | 0.537 | 1.316 | 0.294 | 1.370 | 0.425 |

TABLE 45

Average LDL Normalized to Pre-Treatment from Example 13 (Fasted)

| | Day 8 | | Day 15 | | Day 21 | | Day 29 | | Day 36 | |
| --- | --- | --- | --- | --- | --- | --- | --- | --- | --- | --- |
| Group ID | Avg Total Chol | Std Dev (+/−) | Avg Total Chol | Std Dev (+/−) | Avg Total Chol | Std Dev (+/−) | Avg Total Chol | Std Dev (+/−) | Avg Total Chol | Std Dev (+/−) |
| Group 1 (saline control) | 0.892 | 0.060 | 0.928 | 0.046 | 0.823 | 0.034 | 0.804 | 0.076 | 0.804 | 0.172 |
| Group 2 (4.0 mg/kg AD05876) | 0.777 | 0.129 | 0.856 | 0.136 | 0.842 | 0.186 | 0.755 | 0.144 | 0.716 | 0.228 |

The Rhesus monkeys dosed with AD05876 at 4.0 mg/kg dosage levels showed a reduction in APOC3 protein compared to pre-treatment measurements across each of the measured time points. Further, substantial reductions in both triglyceride levels and total cholesterol levels are also shown. For example, in one animal, triglycerides were reduced by approximately 89% on day 22, and as shown in Table 42 above, mean triglyceride levels were reduced by approximately 60% (0.395) on day 22. Additionally, mean HDL levels increased by approximately 47% on day 22 (see Table 44 (1.465)), with one animal having a 2.2-fold increase in HDL levels.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (837 sequences)

SEQ ID NO: 1 - RNA, 533 nt, Homo sapiens
  source 1..533: mol_type = mRNA
tgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 2 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = um
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 21: mod_base = cm
  modified_base 1^2: mod_base = OTHER; note = phosphorothioate linkage
tcactgagaatactgtccctc

SEQ ID NO: 3 - RNA, 21 nt, synthetic construct
  source 1..21: mol_type = other RNA
tcactgagaatactgtccctc

SEQ ID NO: 4 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = um
  modified_base 2: mod_base = OTHER; note = 2'-fluorocytidine
  modified_base 3: mod_base = OTHER; note = 2'-O-methyladenosine
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluoroguanosine
  modified_base 21: mod_base = um
  modified_base 1^2: mod_base = OTHER; note = phosphorothioate linkage
tcactgagaatactgtcccgt

SEQ ID NO: 5 - RNA, 21 nt, synthetic construct
  source 1..21: mol_type = other RNA
tcactgagaatactgtcccgt

SEQ ID NO: 6 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = um
  modified_base 2: mod_base = OTHER; note = 2'-fluorocytidine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorocytidine
  modified_base 21: mod_base = cm
  modified_base 1^2: mod_base = OTHER; note = phosphorothioate linkage
tcactgagaatactttccctc

SEQ ID NO: 7 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = um
  modified_base 2: mod_base = OTHER; note = 2'-fluorouridine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 21: mod_base = cm
  modified_base 1^2: mod_base = OTHER; note = phosphorothioate linkage
ttcttgtccagctttattggc

SEQ ID NO: 8 - RNA, 21 nt, synthetic construct
  source 1..21: mol_type = other RNA
ttcttgtccagctttattggc

SEQ ID NO: 9 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = OTHER; note = 2'-O-methyladenosine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroguanosine
  modified_base 21: mod_base = gm
  modified_base 1^2: mod_base = OTHER; note = phosphorothioate linkage
agaatactgtcccttttaggg

SEQ ID NO: 10 - RNA, 21 nt, synthetic construct
  source 1..21: mol_type = other RNA
agaatactgtcccttttaggg

SEQ ID NO: 11 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = OTHER; note = 2'-O-methyladenosine
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluoroguanosine
  modified_base 21: mod_base = cm
  modified_base 1^2: mod_base = OTHER; note = phosphorothioate linkage
agaatactgtcccttttaagc

SEQ ID NO: 12 - RNA, 21 nt, synthetic construct
  source 1..21: mol_type = other RNA
agaatactgtcccttttaagc

SEQ ID NO: 13 - RNA, 21 nt, synthetic construct
  source 1..21: mol_type = other RNA
  modified_base 2^3: mod_base = OTHER; note = phosphorothioate linkage
  modified_base 3^4: mod_base = OTHER; note = phosphorothioate linkage
  modified_base 20^21: mod_base = OTHER; note = phosphorothioate linkage
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = gm
  modified_base 20: mod_base = cm
  modified_base 21: mod_base = cm
  modified_base 1^2: mod_base = OTHER; note = phosphorothioate linkage
tgagaatactgtccctttgcc

SEQ ID NO: 14 - RNA, 21 nt, synthetic construct
  source 1..21: mol_type = other RNA
tgagaatactgtccctttgcc

SEQ ID NO: 15 - RNA, 21 nt, synthetic construct
  source 1..21: mol_type = other RNA
  modified_base 1: mod_base = gm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  modified_base 2: mod_base = OTHER; note = 2'-O-methyladenosine
gagggacagtattctcagtna

SEQ ID NO: 16 - RNA, 21 nt, synthetic construct
  source 1..21: mol_type = other RNA
  modified_base 20: mod_base = i
gagggacagtattctcagtna

SEQ ID NO: 17 - RNA, 21 nt, synthetic construct
  source 1..21: mol_type = other RNA
  modified_base 2: mod_base = cm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  modified_base 1: mod_base = OTHER; note = 2'-O-methyladenosine
acgggacagtattctcagtna

SEQ ID NO: 18 - RNA, 21 nt, synthetic construct
  source 1..21: mol_type = other RNA
  modified_base 20: mod_base = i
acgggacagtattctcagtna

SEQ ID NO: 19 - RNA, 21 nt, synthetic construct
  source 1..21: mol_type = other RNA
  modified_base 1: mod_base = gm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = um
  modified_base 11: mod_base = OTHER; note = 2'-fluoroadenosine
  modified_base 12: mod_base = um
  modified_base 13: mod_base = OTHER; note = 2'-fluorouridine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2-O-methyladenosine
  modified_base 2: mod_base = OTHER; note = 2'-O-methyladenosine
gagggacagtattctcagtna

SEQ ID NO: 20 - RNA, 21 nt, synthetic construct
  source 1..21: mol_type = other RNA
  modified_base 1: mod_base = gm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  modified_base 2: mod_base = OTHER; note = 2'-O-methyladenosine
gagggacagtattctcagtga

SEQ ID NO: 21 - RNA, 21 nt, synthetic construct
  source 1..21: mol_type = other RNA
gagggacagtattctcagtga

SEQ ID NO: 22 - RNA, 21 nt, synthetic construct
  source 1..21: mol_type = other RNA
  modified_base 1: mod_base = gm
  modified_base 2: mod_base = cm
  modified_base 3: mod_base = cm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  modified_base 4: mod_base = OTHER; note = 2'-O-methyladenosine
gccaataaagctggacaagaa

SEQ ID NO: 23 - RNA, 21 nt, synthetic construct
  source 1..21: mol_type = other RNA
gccaataaagctggacaagaa

SEQ ID NO: 24 - RNA, 21 nt, synthetic construct
  source 1..21: mol_type = other RNA
  modified_base 1: mod_base = gm
  modified_base 2: mod_base = cm
  modified_base 3: mod_base = cm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroinosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  modified_base 4: mod_base = OTHER; note = 2'-O-methyladenosine
gccaataaanctggacaagaa

SEQ ID NO: 25 - RNA, 21 nt, synthetic construct
  source 1..21: mol_type = other RNA
  modified_base 10: mod_base = i
gccaataaanctggacaagaa

SEQ ID NO: 26 - RNA, 21 nt, synthetic construct
  source 1..21: mol_type = other RNA
  modified_base 1: mod_base = cm
  modified_base 2: mod_base = cm
  modified_base 3: mod_base = cm
  modified_base 4: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  modified_base 5: mod_base = OTHER; note = 2'-O-methyladenosine
ccctaaaagggacagtattct

SEQ ID NO: 27 - RNA, 21 nt, synthetic construct
  source 1..21: mol_type = other RNA
ccctaaaagggacagtattct

SEQ ID NO: 28 - RNA, 21 nt, synthetic construct
  source 1..21: mol_type = other RNA
  modified_base 1: mod_base = gm
  modified_base 2: mod_base = cm
  modified_base 3: mod_base = um
  modified_base 4: mod_base = um
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  modified_base 5: mod_base = OTHER; note = 2'-O-methyladenosine
gcttaaaagggacagtattct

SEQ ID NO: 29 - RNA, 21 nt, synthetic construct
  source 1..21: mol_type = other RNA
gcttaaaagggacagtattct

SEQ ID NO: 30 - RNA, 21 nt, synthetic construct
  source 1..21: mol_type = other RNA
  modified_base 1: mod_base = gm
  modified_base 2: mod_base = gm
  modified_base 3: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  modified_base 4: mod_base = OTHER; note = 2'-O-methyladenosine
ggcaaagggacagtattctca

SEQ ID NO: 31 - RNA, 21 nt, synthetic construct
  source 1..21: mol_type = other RNA
ggcaaagggacagtattctca

SEQ ID NO: 32 - RNA, 19 nt, synthetic construct
  source 1..19: mol_type = other RNA
gggacagtattctcagtgc

SEQ ID NO: 33 - RNA, 19 nt, synthetic construct
  source 1..19: mol_type = other RNA
caataaagctggacaagaa

SEQ ID NO: 34 - RNA, 19 nt, synthetic construct
  source 1..19: mol_type = other RNA
ttaaaagggacagtattct

SEQ ID NO: 35 - RNA, 19 nt, synthetic construct
  source 1..19: mol_type = other RNA
cgggtactccttgttgttg

SEQ ID NO: 36 - RNA, 19 nt, synthetic construct
  source 1..19: mol_type = other RNA
ggtactccttgttgttgcc

SEQ ID NO: 37 - RNA, 19 nt, synthetic construct
  source 1..19: mol_type = other RNA
gctgggtgaccgatggctt

SEQ ID NO: 38 - RNA, 19 nt, synthetic construct
  source 1..19: mol_type = other RNA
gaccgatggcttcagttcc

SEQ ID NO: 39 - RNA, 19 nt, synthetic construct
  source 1..19: mol_type = other RNA
gcttcagttccctgaaaga

SEQ ID NO: 40 - RNA, 19 nt, synthetic construct
  source 1..19: mol_type = other RNA
tcagttccctgaaagacta

SEQ ID NO: 41 - RNA, 19 nt, synthetic construct
  source 1..19: mol_type = other RNA
gactactggagcaccgtta

SEQ ID NO: 42 - RNA, 19 nt, synthetic construct
  source 1..19: mol_type = other RNA
actactggagcaccgttaa

SEQ ID NO: 43 - RNA, 19 nt, synthetic construct
  source 1..19: mol_type = other RNA
gcaccgttaaggacaagtt

SEQ ID NO: 44 - RNA, 19 nt, synthetic construct
  source 1..19: mol_type = other RNA
accgttaaggacaagttct

SEQ ID NO: 45 - RNA, 19 nt, synthetic construct
  source 1..19: mol_type = other RNA
ccgttaaggacaagttctc

SEQ ID NO: 46 - RNA, 19 nt, synthetic construct
  source 1..19: mol_type = other RNA
cctcaataccccaagtcca

SEQ ID NO: 47 - RNA, 19 nt, synthetic construct
  source 1..19: mol_type = other RNA
aaaagggacagtattctca

SEQ ID NO: 48 - RNA, 19 nt, synthetic construct
  source 1..19: mol_type = other RNA
agggacagtattctcagtg

SEQ ID NO: 49 - RNA, 19 nt, synthetic construct
  source 1..19: mol_type = other RNA
tcactgagaatactgtccc

SEQ ID NO: 50 - RNA, 19 nt, synthetic construct
  source 1..19: mol_type = other RNA
gcactgagaatactgtccc

SEQ ID NO: 51 - RNA, 19 nt, synthetic construct
  source 1..19: mol_type = other RNA
ncactgagaatactgtccc

SEQ ID NO: 52 - RNA, 19 nt, synthetic construct
  source 1..19: mol_type = other RNA
ncactgagaatactgtccn

SEQ ID NO: 53 - RNA, 19 nt, synthetic construct
  source 1..19: mol_type = other RNA
ttcttgtccagctttattg

SEQ ID NO: 54 - RNA, 19 nt, synthetic construct
  source 1..19: mol_type = other RNA
ntcttgtccagctttattg

SEQ ID NO: 55 - RNA, 19 nt, synthetic construct
  source 1..19: mol_type = other RNA
ntcttgtccagctttattn

SEQ ID NO: 56 - RNA, 19 nt, synthetic construct
  source 1..19: mol_type = other RNA
tgaatactgtcccttttaa

SEQ ID NO: 57 - RNA, 19 nt, synthetic construct
  source 1..19: mol_type = other RNA
agaatactgtcccttttaa

SEQ ID NO: 58 - RNA, 19 nt, synthetic construct
  source 1..19: mol_type = other RNA
agaatactgtcccttttag

SEQ ID NO: 59 - RNA, 19 nt, synthetic construct
  source 1..19: mol_type = other RNA
ngaatactgtcccttttaa

SEQ ID NO: 60 - RNA, 19 nt, synthetic construct
  source 1..19: mol_type = other RNA
ngaatactgtcccttttag

SEQ ID NO: 61 - RNA, 19 nt, synthetic construct
  source 1..19: mol_type = other RNA
ngaatactgtcccttttan

SEQ ID NO: 62 - RNA, 19 nt, synthetic construct
  source 1..19: mol_type = other RNA
taacaacaaggagtacccg

SEQ ID NO: 63 - RNA, 19 nt, synthetic construct
  source 1..19: mol_type = other RNA
caacaacaaggagtacccg

SEQ ID NO: 64 - RNA, 19 nt, synthetic construct
  source 1..19: mol_type = other RNA
naacaacaaggagtacccg

SEQ ID NO: 65 - RNA, 19 nt, synthetic construct
  source 1..19: mol_type = other RNA
naacaacaaggagtacccn

SEQ ID NO: 66 - RNA, 19 nt, synthetic construct
  source 1..19: mol_type = other RNA
tgcaacaacaaggagtacc

SEQ ID NO: 67 - RNA, 19 nt, synthetic construct
  source 1..19: mol_type = other RNA
ggcaacaacaaggagtacc

SEQ ID NO: 68 - RNA, 19 nt, synthetic construct
  source 1..19: mol_type = other RNA
ngcaacaacaaggagtacc

SEQ ID NO: 69 - RNA, 19 nt, synthetic construct
  source 1..19: mol_type = other RNA
ngcaacaacaaggagtacn

SEQ ID NO: 70 - RNA, 19 nt, synthetic construct
  source 1..19: mol_type = other RNA
tagccatcggtcacccagc

SEQ ID NO: 71 - RNA, 19 nt, synthetic construct
  source 1..19: mol_type = other RNA
aagccatcggtcacccagc

SEQ ID NO: 72 - RNA, 19 nt, synthetic construct
  source 1..19: mol_type = other RNA
nagccatcggtcacccagc

SEQ ID NO: 73 - RNA, 19 nt, synthetic construct
  source 1..19: mol_type = other RNA
nagccatcggtcacccagn

SEQ ID NO: 74 - RNA, 19 nt, synthetic construct
  source 1..19: mol_type = other RNA
tgaactgaagccatcggtc

SEQ ID NO: 75 - RNA, 19 nt, synthetic construct
  source 1..19: mol_type = other RNA
ggaactgaagccatcggtc

SEQ ID NO: 76 - RNA, 19 nt, synthetic construct
  source 1..19: mol_type = other RNA
ngaactgaagccatcggtc

SEQ ID NO: 77 - RNA, 19 nt, synthetic construct
  source 1..19: mol_type = other RNA
ngaactgaagccatcggtn

SEQ ID NO: 78 - RNA, 19 nt, synthetic construct
  source 1..19: mol_type = other RNA
tctttcagggaactgaagc

SEQ ID NO: 79 - RNA, 19 nt, synthetic construct
  source 1..19: mol_type = other RNA
nctttcagggaactgaagc

SEQ ID NO: 80 - RNA, 19 nt, synthetic construct
  source 1..19: mol_type = other RNA
nctttcagggaactgaagn

SEQ ID NO: 81 - RNA, 19 nt, synthetic construct
  source 1..19: mol_type = other RNA
tagtctttcagggaactga

SEQ ID NO: 82 - RNA, 19 nt, synthetic construct
  source 1..19: mol_type = other RNA
nagtctttcagggaactga

SEQ ID NO: 83 - RNA, 19 nt, synthetic construct
  source 1..19: mol_type = other RNA
nagtctttcagggaactgn

SEQ ID NO: 84 - RNA, 19 nt, synthetic construct
  source 1..19: mol_type = other RNA
taacggtgctccagtagtc

SEQ ID NO: 85 - RNA, 19 nt, synthetic construct
  source 1..19: mol_type = other RNA
naacggtgctccagtagtc

SEQ ID NO: 86 - RNA, 19 nt, synthetic construct
  source 1..19: mol_type = other RNA
naacggtgctccagtagtn

SEQ ID NO: 87 - RNA, 19 nt, synthetic construct
  source 1..19: mol_type = other RNA
ttaacggtgctccagtagt

SEQ ID NO: 88 - RNA, 19 nt, synthetic construct
  source 1..19: mol_type = other RNA
ntaacggtgctccagtagt

SEQ ID NO: 89 - RNA, 19 nt, synthetic construct
  source 1..19: mol_type = other RNA
ntaacggtgctccagtagn

SEQ ID NO: 90 - RNA, 19 nt, synthetic construct
  source 1..19: mol_type = other RNA
tacttgtccttaacggtgc

SEQ ID NO: 91 - RNA, 19 nt, synthetic construct
  source 1..19: mol_type = other RNA
aacttgtccttaacggtgc

SEQ ID NO: 92 - RNA, 19 nt, synthetic construct
  source 1..19: mol_type = other RNA
nacttgtccttaacggtgc

SEQ ID NO: 93 - RNA, 19 nt, synthetic construct
  source 1..19: mol_type = other RNA
nacttgtccttaacggtgn

SEQ ID NO: 94 - RNA, 19 nt, synthetic construct
  source 1..19: mol_type = other RNA
tgaacttgtccttaacggt

SEQ ID NO: 95 - RNA, 19 nt, synthetic construct
  source 1..19: mol_type = other RNA
agaacttgtccttaacggt

SEQ ID NO: 96 - RNA, 19 nt, synthetic construct
  source 1..19: mol_type = other RNA
ngaacttgtccttaacggt

SEQ ID NO: 97 - RNA, 19 nt, synthetic construct
  source 1..19: mol_type = other RNA
ngaacttgtccttaacggn

SEQ ID NO: 98 - RNA, 19 nt, synthetic construct
  source 1..19: mol_type = other RNA
tagaacttgtccttaacgg

SEQ ID NO: 99 - RNA, 19 nt, synthetic construct
  source 1..19: mol_type = other RNA
gagaacttgtccttaacgg

SEQ ID NO: 100 - RNA, 19 nt, synthetic construct
  source 1..19: mol_type = other RNA
nagaacttgtccttaacgg

SEQ ID NO: 101 - RNA, 19 nt, synthetic construct
  source 1..19: mol_type = other RNA
nagaacttgtccttaacgn

SEQ ID NO: 102 - RNA, 19 nt, synthetic construct
  source 1..19: mol_type = other RNA
tggacttggggtattgagg

SEQ ID NO: 103 - RNA, 19 nt, synthetic construct
  source 1..19: mol_type = other RNA
nggacttggggtattgagg

SEQ ID NO: 104 - RNA, 19 nt, synthetic construct
  source 1..19: mol_type = other RNA
nggacttggggtattgagn

SEQ ID NO: 105 - RNA, 19 nt, synthetic construct
  source 1..19: mol_type = other RNA
tgagaatactgtccctttt

SEQ ID NO: 106 - RNA, 19 nt, synthetic construct
  source 1..19: mol_type = other RNA
tgagaatactgtccctttg

SEQ ID NO: 107 - RNA, 19 nt, synthetic construct
  source 1..19: mol_type = other RNA
ngagaatactgtccctttt

SEQ ID NO: 108 - RNA, 19 nt, synthetic construct
  source 1..19: mol_type = other RNA
ngagaatactgtccctttg

SEQ ID NO: 109 - RNA, 19 nt, synthetic construct
  source 1..19: mol_type = other RNA
ngagaatactgtccctttn

SEQ ID NO: 110 - RNA, 19 nt, synthetic construct
  source 1..19: mol_type = other RNA
tactgagaatactgtccct

SEQ ID NO: 111 - RNA, 19 nt, synthetic construct
  source 1..19: mol_type = other RNA
cactgagaatactgtccct

SEQ ID NO: 112 - RNA, 19 nt, synthetic construct
  source 1..19: mol_type = other RNA
nactgagaatactgtccct

SEQ ID NO: 113 - RNA, 19 nt, synthetic construct
  source 1..19: mol_type = other RNA
nactgagaatactgtcccn

SEQ ID NO: 114 - RNA, 19 nt, synthetic construct
  source 1..19: mol_type = other RNA
gggacagtattctcagtga

SEQ ID NO: 115 - RNA, 19 nt, synthetic construct
  source 1..19: mol_type = other RNA
  modified_base 18: mod_base = i
gggacagtattctcagtna

SEQ ID NO: 116 - RNA, 19 nt, synthetic construct
  source 1..19: mol_type = other RNA
gggacagtattctcagtgc

SEQ ID NO: 117 - RNA, 19 nt, synthetic construct
  source 1..19: mol_type = other RNA
gggacagtattctcagtgn

SEQ ID NO: 118 - RNA, 19 nt, synthetic construct
  source 1..19: mol_type = other RNA
nggacagtattctcagtgn

SEQ ID NO: 119 - RNA, 19 nt, synthetic construct
  source 1..19: mol_type = other RNA
caataaagctggacaagaa

SEQ ID NO: 120 - RNA, 19 nt, synthetic construct
  source 1..19: mol_type = other RNA
  modified_base 8: mod_base = i
caataaanctggacaagaa

SEQ ID NO: 121 - RNA, 19 nt, synthetic construct
  source 1..19: mol_type = other RNA
caataaagctggacaagan

SEQ ID NO: 122 - RNA, 19 nt, synthetic construct
  source 1..19: mol_type = other RNA
naataaagctggacaagan

SEQ ID NO: 123 - RNA, 19 nt, synthetic construct
  source 1..19: mol_type = other RNA
ttaaaagggacagtattca

SEQ ID NO: 124 - RNA, 19 nt, synthetic construct
  source 1..19: mol_type = other RNA
ttaaaagggacagtattct

SEQ ID NO: 125 - RNA, 19 nt, synthetic construct
  source 1..19: mol_type = other RNA
ctaaaagggacagtattct

SEQ ID NO: 126 - RNA, 19 nt, synthetic construct
  source 1..19: mol_type = other RNA
ttaaaagggacagtattcn

SEQ ID NO: 127 - RNA, 19 nt, synthetic construct
  source 1..19: mol_type = other RNA
ctaaaagggacagtattcn

SEQ ID NO: 128 - RNA, 19 nt, synthetic construct
  source 1..19: mol_type = other RNA
ntaaaagggacagtattcn

SEQ ID NO: 129 - RNA, 19 nt, synthetic construct
  source 1..19: mol_type = other RNA
cgggtactccttgttgtta

SEQ ID NO: 130 - RNA, 19 nt, synthetic construct
  source 1..19: mol_type = other RNA
cgggtactccttgttgttg

SEQ ID NO: 131 - RNA, 19 nt, synthetic construct
  source 1..19: mol_type = other RNA
cgggtactccttgttgttn

SEQ ID NO: 132 - RNA, 19 nt, synthetic construct
  source 1..19: mol_type = other RNA
ngggtactccttgttgttn

SEQ ID NO: 133 - RNA, 19 nt, synthetic construct
  source 1..19: mol_type = other RNA
ggtactccttgttgttgca

SEQ ID NO: 134 - RNA, 19 nt, synthetic construct
  source 1..19: mol_type = other RNA
ggtactccttgttgttgcc

SEQ ID NO: 135 - RNA, 19 nt, synthetic construct
  source 1..19: mol_type = other RNA
ggtactccttgttgttgcn

SEQ ID NO: 136 - RNA, 19 nt, synthetic construct
  source 1..19: mol_type = other RNA
ngtactccttgttgttgcn

SEQ ID NO: 137 - RNA, 19 nt, synthetic construct
  source 1..19: mol_type = other RNA
gctgggtgaccgatggcta

SEQ ID NO: 138 - RNA, 19 nt, synthetic construct
  source 1..19: mol_type = other RNA
gctgggtgaccgatggctt

SEQ ID NO: 139 - RNA, 19 nt, synthetic construct
  source 1..19: mol_type = other RNA
gctgggtgaccgatggctn

SEQ ID NO: 140 - RNA, 19 nt, synthetic construct
  source 1..19: mol_type = other RNA
nctgggtgaccgatggctn

SEQ ID NO: 141 - RNA, 19 nt, synthetic construct
  source 1..19: mol_type = other RNA
gaccgatggcttcagttca

SEQ ID NO: 142 - RNA, 19 nt, synthetic construct
  source 1..19: mol_type = other RNA
gaccgatggcttcagttcc

SEQ ID NO: 143 - RNA, 19 nt, synthetic construct
  source 1..19: mol_type = other RNA
gaccgatggcttcagttcn

SEQ ID NO: 144 - RNA, 19 nt, synthetic construct
  source 1..19: mol_type = other RNA
naccgatggcttcagttcn

SEQ ID NO: 145 - RNA, 19 nt, synthetic construct
  source 1..19: mol_type = other RNA
gcttcagttccctgaaaga

SEQ ID NO: 146 - RNA, 19 nt, synthetic construct
  source 1..19: mol_type = other RNA
gcttcagttccctgaaagn

SEQ ID NO: 147 - RNA, 19 nt, synthetic construct
  source 1..19: mol_type = other RNA
ncttcagttccctgaaagn

SEQ ID NO: 148 - RNA, 19 nt, synthetic construct
  source 1..19: mol_type = other RNA
tcagttccctgaaagacta

SEQ ID NO: 149 - RNA, 19 nt, synthetic construct
  source 1..19: mol_type = other RNA
tcagttccctgaaagactn

SEQ ID NO: 150 - RNA, 19 nt, synthetic construct
  source 1..19: mol_type = other RNA
ncagttccctgaaagactn

SEQ ID NO: 151 - RNA, 19 nt, synthetic construct
  source 1..19: mol_type = other RNA
gactactggagcaccgtta

SEQ ID NO: 152 - RNA, 19 nt, synthetic construct
  source 1..19: mol_type = other RNA
gactactggagcaccgttn

SEQ ID NO: 153 - RNA, 19 nt, synthetic construct
  source 1..19: mol_type = other RNA
nactactggagcaccgttn

SEQ ID NO: 154 - RNA, 19 nt, synthetic construct
  source 1..19: mol_type = other RNA
actactggagcaccgttaa

SEQ ID NO: 155 - RNA, 19 nt, synthetic construct
  source 1..19: mol_type = other RNA
actactggagcaccgttan

SEQ ID NO: 156 - RNA, 19 nt, synthetic construct
  source 1..19: mol_type = other RNA
nctactggagcaccgttan

SEQ ID NO: 157 - RNA, 19 nt, synthetic construct
  source 1..19: mol_type = other RNA
gcaccgttaaggacaagta

SEQ ID NO: 158 - RNA, 19 nt, synthetic construct
  source 1..19: mol_type = other RNA
gcaccgttaaggacaagtt

SEQ ID NO: 159 - RNA, 19 nt, synthetic construct
  source 1..19: mol_type = other RNA
gcaccgttaaggacaagtn

SEQ ID NO: 160 - RNA, 19 nt, synthetic construct
  source 1..19: mol_type = other RNA
ncaccgttaaggacaagtn

SEQ ID NO: 161 - RNA, 19 nt, synthetic construct
  source 1..19: mol_type = other RNA
accgttaaggacaagttca

SEQ ID NO: 162 - RNA, 19 nt, synthetic construct
  source 1..19: mol_type = other RNA
accgttaaggacaagttct

SEQ ID NO: 163 - RNA, 19 nt, synthetic construct
  source 1..19: mol_type = other RNA
accgttaaggacaagttcn

SEQ ID NO: 164 - RNA, 19 nt, synthetic construct
  source 1..19: mol_type = other RNA
nccgttaaggacaagttcn

SEQ ID NO: 165 - RNA, 19 nt, synthetic construct
  source 1..19: mol_type = other RNA
ccgttaaggacaagttcta

SEQ ID NO: 166 - RNA, 19 nt, synthetic construct
  source 1..19: mol_type = other RNA
ccgttaaggacaagttctc

SEQ ID NO: 167 - RNA, 19 nt, synthetic construct
  source 1..19: mol_type = other RNA
ccgttaaggacaagttctn

SEQ ID NO: 168 - RNA, 19 nt, synthetic construct
  source 1..19: mol_type = other RNA
ncgttaaggacaagttctn

SEQ ID NO: 169 - RNA, 19 nt, synthetic construct
  source 1..19: mol_type = other RNA
cctcaataccccaagtcca

SEQ ID NO: 170 - RNA, 19 nt, synthetic construct
  source 1..19: mol_type = other RNA
cctcaataccccaagtccn

SEQ ID NO: 171 - RNA, 19 nt, synthetic construct
  source 1..19: mol_type = other RNA
nctcaataccccaagtccn

SEQ ID NO: 172 - RNA, 19 nt, synthetic construct
  source 1..19: mol_type = other RNA
aaaagggacagtattctca

SEQ ID NO: 173 - RNA, 19 nt, synthetic construct
  source 1..19: mol_type = other RNA
caaagggacagtattctca

SEQ ID NO: 174 - RNA, 19 nt, synthetic construct
  source 1..19: mol_type = other RNA
aaaagggacagtattctcn

SEQ ID NO: 175 - RNA, 19 nt, synthetic construct
  source 1..19: mol_type = other RNA
caaagggacagtattctcn

SEQ ID NO: 176 - RNA, 19 nt, synthetic construct
  source 1..19: mol_type = other RNA
naaagggacagtattctcn

SEQ ID NO: 177 - RNA, 19 nt, synthetic construct
  source 1..19: mol_type = other RNA
agggacagtattctcagta

SEQ ID NO: 178 - RNA, 19 nt, synthetic construct
  source 1..19: mol_type = other RNA
agggacagtattctcagtg

SEQ ID NO: 179 - RNA, 19 nt, synthetic construct
  source 1..19: mol_type = other RNA
agggacagtattctcagtn

SEQ ID NO: 180 - RNA, 19 nt, synthetic construct
  source 1..19: mol_type = other RNA
ngggacagtattctcagtn

SEQ ID NO: 181 - RNA, 21 nt, synthetic construct
  modified_base 1: mod_base = um
  modified_base 3: mod_base = OTHER; note = 2'-O-methyladenosine
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluoroadenosine
  modified_base 9: mod_base = OTHER; note = 2'-fluoroadenosine
  modified_base 10: mod_base = OTHER; note = 2'-fluoroguanosine
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = um
  modified_base 21: mod_base = um
  source 1..21: mol_type = other RNA
  modified_base 2: mod_base = OTHER; note = 2'-fluoroadenosine
taacaacaaggagtacccgtt

SEQ ID NO: 182 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = um
  modified_base 21: mod_base = um
  source 1..21: mol_type = other RNA
taacaacaaggagtacccgtt

SEQ ID NO: 183 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = gm
  modified_base 21: mod_base = um
  source 1..21: mol_type = other RNA
taacaacaaggagtacccggt

SEQ ID NO: 184 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = gm
  modified_base 21: mod_base = gm
  source 1..21: mol_type = other RNA
taacaacaaggagtacccggg

SEQ ID NO: 185 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = gm
  modified_base 21: mod_base = gm
  source 1..21: mol_type = other RNA
taacaacaaggagtacccggg

SEQ ID NO: 186 - RNA, 21 nt, synthetic construct
  modified_base 1: mod_base = um
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 21: mod_base = um
  source 1..21: mol_type = other RNA
tgcaacaacaaggagtacctt

SEQ ID NO: 187 - RNA, 21 nt, synthetic construct
  modified_base 1: mod_base = um
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 21: mod_base = um
  source 1..21: mol_type = other RNA
tgcaacaacaaggagtacctt

SEQ ID NO: 188 - RNA, 21 nt, synthetic construct
  modified_base 1: mod_base = um
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 21: mod_base = um
  source 1..21: mol_type = other RNA
tgcaacaacaaggagtaccct

SEQ ID NO: 189 - RNA, 21 nt, synthetic construct
  modified_base 1: mod_base = um
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 21: mod_base = gm
  source 1..21: mol_type = other RNA
tgcaacaacaaggagtacccg

SEQ ID NO: 190 - RNA, 21 nt, synthetic construct
  modified_base 1: mod_base = um
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 21: mod_base = gm
  source 1..21: mol_type = other RNA
tgcaacaacaaggagtacccg

SEQ ID NO: 191 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = OTHER; note = 2'-fluoroguanosine
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tagccatcggtcacccagctt

SEQ ID NO: 192 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tagccatcggtcacccagctt

SEQ ID NO: 193 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = um
  source 1..21: mol_type = other RNA
tagccatcggtcacccagcct

SEQ ID NO: 194 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = cm
  source 1..21: mol_type = other RNA
tagccatcggtcacccagccc

SEQ ID NO: 195 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = cm
  modified_base 9: mod_base = gm
  modified_base 10: mod_base = gm
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = cm
  source 1..21: mol_type = other RNA
tagccatcggtcacccagccc

SEQ ID NO: 196 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-fluoroadenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
tgaactgaagccatcggtctt

SEQ ID NO: 197 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
tgaactgaagccatcggtctt

SEQ ID NO: 198 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = OTHER; note = 2'-O-methyladenosine
  modified_base 21: mod_base = um
  source 1..21: mol_type = other RNA
tgaactgaagccatcggtcat

SEQ ID NO: 199 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = OTHER; note = 2'-O-methyladenosine
  modified_base 21: mod_base = cm
  source 1..21: mol_type = other RNA
tgaactgaagccatcggtcac

SEQ ID NO: 200 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = OTHER; note = 2'-O-methyladenosine
  modified_base 21: mod_base = cm
  source 1..21: mol_type = other RNA
tgaactgaagccatcggtcac

SEQ ID NO: 201 - RNA, 21 nt, synthetic construct
  modified_base 1: mod_base = um
  modified_base 2: mod_base = OTHER; note = 2'-fluorocytidine
  modified_base 3: mod_base = um
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tctttcagggaactgaagctt

SEQ ID NO: 202 - RNA, 21 nt, synthetic construct
  modified_base 1: mod_base = um
  modified_base 2: mod_base = OTHER; note = 2'-fluorocytidine
  modified_base 3: mod_base = um
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tctttcagggaactgaagctt

SEQ ID NO: 203 - RNA, 21 nt, synthetic construct
  modified_base 1: mod_base = um
  modified_base 2: mod_base = OTHER; note = 2'-fluorocytidine
  modified_base 3: mod_base = um
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = um
  source 1..21: mol_type = other RNA
tctttcagggaactgaagcct

SEQ ID NO: 204 - RNA, 21 nt, synthetic construct
  modified_base 1: mod_base = um
  modified_base 2: mod_base = OTHER; note = 2'-fluorocytidine
  modified_base 3: mod_base = um
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = OTHER; note = 2'-O-methyladenosine
  source 1..21: mol_type = other RNA
tctttcagggaactgaagcca

SEQ ID NO: 205 - RNA, 21 nt, synthetic construct
  modified_base 1: mod_base = um
  modified_base 2: mod_base = OTHER; note = 2'-fluorocytidine
  modified_base 3: mod_base = um
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = gm
  modified_base 10: mod_base = gm
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 21: mod_base = OTHER; note = 2'-O-methyladenosine
  source 1..21: mol_type = other RNA
tctttcagggaactgaagcca

SEQ ID NO: 206 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = OTHER; note = 2'-fluorocytidine
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
taacggtgctccagtagtctt

SEQ ID NO: 207 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
taacggtgctccagtagtctt

SEQ ID NO: 208 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
taacggtgctccagtagtctt

SEQ ID NO: 209 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
taacggtgctccagtagtctt

SEQ ID NO: 210 - RNA, 21 nt, synthetic construct
  modified_base 1: mod_base = um
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = gm
  modified_base 9: mod_base = cm
  modified_base 10: mod_base = um
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 21: mod_base = um
  source 1..21: mol_type = other RNA
taacggtgctccagtagtctt

SEQ ID NO: 211 - RNA, 21 nt, synthetic construct
  modified_base 1: mod_base = um
  modified_base 2: mod_base = OTHER; note = 2'-fluorouridine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = um
  modified_base 21: mod_base = um
  source 1..21: mol_type = other RNA
ttaacggtgctccagtagttt

SEQ ID NO: 212 - RNA, 21 nt, synthetic construct
  modified_base 1: mod_base = um
  modified_base 2: mod_base = OTHER; note = 2'-fluorouridine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = um
  modified_base 21: mod_base = um
  source 1..21: mol_type = other RNA
ttaacggtgctccagtagttt

SEQ ID NO: 213 - RNA, 21 nt, synthetic construct
  modified_base 1: mod_base = um
  modified_base 2: mod_base = OTHER; note = 2'-fluorouridine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 21: mod_base = um
  source 1..21: mol_type = other RNA
ttaacggtgctccagtagtct

SEQ ID NO: 214 - RNA, 21 nt, synthetic construct
  modified_base 1: mod_base = um
  modified_base 2: mod_base = OTHER; note = 2'-fluorouridine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 21: mod_base = um
  source 1..21: mol_type = other RNA
ttaacggtgctccagtagtct

SEQ ID NO: 215 - RNA, 21 nt, synthetic construct
  modified_base 1: mod_base = um
  modified_base 2: mod_base = OTHER; note = 2'-fluorouridine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = um
  modified_base 9: mod_base = gm
  modified_base 10: mod_base = cm
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 21: mod_base = um
  source 1..21: mol_type = other RNA
ttaacggtgctccagtagtct

SEQ ID NO: 216 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = OTHER; note = 2'-fluorocytidine
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tacttgtccttaacggtgctt

SEQ ID NO: 217 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tacttgtccttaacggtgctt

SEQ ID NO: 218 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = um
  source 1..21: mol_type = other RNA
tacttgtccttaacggtgctt

SEQ ID NO: 219 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  source 1..21: mol_type = other RNA
tacttgtccttaacggtgctc

SEQ ID NO: 220 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = cm
  modified_base 9: mod_base = cm
  modified_base 10: mod_base = um
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  source 1..21: mol_type = other RNA
tacttgtccttaacggtgctc

SEQ ID NO: 221 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = OTHER; note = 2'-fluorouridine
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = um
  modified_base 21: mod_base = um
  source 1..21: mol_type = other RNA
tgaacttgtccttaacggttt

SEQ ID NO: 222 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = um
  modified_base 21: mod_base = um
  source 1..21: mol_type = other RNA
tgaacttgtccttaacggttt

SEQ ID NO: 223 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = gm
  modified_base 21: mod_base = um
  source 1..21: mol_type = other RNA
tgaacttgtccttaacggtgt

SEQ ID NO: 224 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = gm
  modified_base 21: mod_base = cm
  source 1..21: mol_type = other RNA
tgaacttgtccttaacggtgc

SEQ ID NO: 225 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = gm
  modified_base 9: mod_base = um
  modified_base 10: mod_base = cm
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = gm
  modified_base 21: mod_base = cm
  source 1..21: mol_type = other RNA
tgaacttgtccttaacggtgc

SEQ ID NO: 226 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tagaacttgtccttaacggtt

SEQ ID NO: 227 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tagaacttgtccttaacggtt

SEQ ID NO: 228 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tagaacttgtccttaacggtt

SEQ ID NO: 229 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 21: mod_base = gm
  source 1..21: mol_type = other RNA
tagaacttgtccttaacggtg

SEQ ID NO: 230 - RNA, 21 nt, synthetic construct
  modified_base 1: mod_base = um
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = um
  modified_base 9: mod_base = gm
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 21: mod_base = gm
  source 1..21: mol_type = other RNA
tagaacttgtccttaacggtg

SEQ ID NO: 231 - RNA, 21 nt, synthetic construct
  modified_base 1: mod_base = um
  modified_base 2: mod_base = OTHER; note = 2'-fluoroguanosine
  modified_base 3: mod_base = gm
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tggacttggggtattgaggtt

SEQ ID NO: 232 - RNA, 21 nt, synthetic construct
  modified_base 1: mod_base = um
  modified_base 2: mod_base = OTHER; note = 2'-fluoroguanosine
  modified_base 3: mod_base = gm
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tggacttggggtattgaggtt

SEQ ID NO: 233 - RNA, 21 nt, synthetic construct
  modified_base 1: mod_base = um
  modified_base 2: mod_base = OTHER; note = 2'-fluoroguanosine
  modified_base 3: mod_base = gm
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 21: mod_base = um
  source 1..21: mol_type = other RNA
tggacttggggtattgaggtt

SEQ ID NO: 234 - RNA, 21 nt, synthetic construct
  modified_base 1: mod_base = um
  modified_base 2: mod_base = OTHER; note = 2'-fluoroguanosine
  modified_base 3: mod_base = gm
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 21: mod_base = cm
  source 1..21: mol_type = other RNA
tggacttggggtattgaggtc

SEQ ID NO: 235 - RNA, 21 nt, synthetic construct
  modified_base 1: mod_base = um
  modified_base 2: mod_base = OTHER; note = 2'-fluoroguanosine
  modified_base 3: mod_base = gm
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = gm
  modified_base 9: mod_base = gm
  modified_base 10: mod_base = gm
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 21: mod_base = cm
  source 1..21: mol_type = other RNA
tggacttggggtattgaggtc

SEQ ID NO: 236 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = um
  modified_base 21: mod_base = um
  source 1..21: mol_type = other RNA
tgagaatactgtccctttttt

SEQ ID NO: 237 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = um
  modified_base 21: mod_base = um
  source 1..21: mol_type = other RNA
tgagaatactgtccctttttt

SEQ ID NO: 238 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = OTHER; note = 2'-O-methyladenosine
  modified_base 21: mod_base = um
  source 1..21: mol_type = other RNA
tgagaatactgtcccttttat

SEQ ID NO: 239 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
tgagaatactgtcccttttaa

SEQ ID NO: 240 - RNA, 21 nt, synthetic construct
  modified_base 1: mod_base = um
  modified_base 2: mod_base = OTHER; note = 2'-fluoroguanosine
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-O-methyladenosine
  modified_base 9: mod_base = cm
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
tgagaatactgtcccttttaa

SEQ ID NO: 241 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 21: mod_base = um
  source 1..21: mol_type = other RNA
tactgagaatactgtcccttt

SEQ ID NO: 242 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 21: mod_base = um
  source 1..21: mol_type = other RNA
tactgagaatactgtcccttt

SEQ ID NO: 243 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 21: mod_base = um
  source 1..21: mol_type = other RNA
tactgagaatactgtcccttt

SEQ ID NO: 244 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 21: mod_base = um
  source 1..21: mol_type = other RNA
tactgagaatactgtcccttt

SEQ ID NO: 245 - RNA, 21 nt, synthetic construct
  modified_base 1: mod_base = um
  modified_base 2: mod_base = OTHER; note = 2'-fluoroadenosine
  modified_base 3: mod_base = cm
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = um
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 21: mod_base = um
  source 1..21: mol_type = other RNA
tactgagaatactgtcccttt

SEQ ID NO: 246 - RNA, 21 nt, synthetic construct
  modified_base 1: mod_base = cm
  modified_base 2: mod_base = gm
  modified_base 3: mod_base = OTHER; note = 2'-fluoroguanosine
  modified_base 4: mod_base = gm
  modified_base 5: mod_base = OTHER; note = 2'-fluorouridine
  modified_base 6: mod_base = OTHER; note = 2'-O-methyladenosine
  modified_base 7: mod_base = OTHER; note = 2'-fluorocytidine
  modified_base 8: mod_base = OTHER; note = 2'-fluorouridine
  modified_base 9: mod_base = OTHER; note = 2'-fluorocytidine
  modified_base 10: mod_base = cm
  modified_base 11: mod_base = OTHER; note = 2'-fluorouridine
  modified_base 12: mod_base = um
  modified_base 13: mod_base = OTHER; note = 2'-fluoroguanosine
  modified_base 14: mod_base = um
  modified_base 15: mod_base = OTHER; note = 2'-fluorouridine
  modified_base 16: mod_base = gm
  modified_base 17: mod_base = OTHER; note = 2'-fluorouridine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
cgggtactccttgttgttatt

SEQ ID NO: 247 - RNA, 21 nt, synthetic construct
  modified_base 1: mod_base = cm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = OTHER; note = 2'-fluorouridine
  modified_base 9: mod_base = OTHER; note = 2'-fluorocytidine
  modified_base 10: mod_base = cm
  modified_base 11: mod_base = um
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
cgggtactccttgttgttatt

SEQ ID NO: 248 - RNA, 20 nt, synthetic construct
  modified_base 1: mod_base = cm
  modified_base 2: mod_base = cm
  modified_base 3: mod_base = gm
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = OTHER; note = 2'-fluorocytidine
  modified_base 9: mod_base = OTHER; note = 2'-fluorouridine
  modified_base 10: mod_base = OTHER; note = 2'-fluorocytidine
  modified_base 11: mod_base = cm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = um
  modified_base 19: mod_base = um
  modified_base 20: mod_base = OTHER; note = 2'-O-methyladenosine
  source 1..20: mol_type = other RNA
ccgggtactccttgttgtta

SEQ ID NO: 249 - RNA, 21 nt, synthetic construct
  modified_base 1: mod_base = cm
  modified_base 2: mod_base = cm
  modified_base 3: mod_base = cm
  modified_base 4: mod_base = gm
  modified_base 5: mod_base = gm
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = gm
  modified_base 16: mod_base = um
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
cccgggtactccttgttgtta

SEQ ID NO: 250 - RNA, 21 nt, synthetic construct
  modified_base 1: mod_base = cm
  modified_base 2: mod_base = cm
  modified_base 3: mod_base = cm
  modified_base 4: mod_base = gm
  modified_base 5: mod_base = gm
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = gm
  modified_base 16: mod_base = um
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
cccgggtactccttgttgtta

SEQ ID NO: 251 - RNA, 21 nt, synthetic construct
  modified_base 1: mod_base = gm
  modified_base 2: mod_base = gm
  modified_base 3: mod_base = OTHER; note = 2'-fluorouridine
  modified_base 4: mod_base = OTHER; note = 2'-O-methyladenosine
  modified_base 5: mod_base = OTHER; note = 2'-fluorocytidine
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = OTHER; note = 2'-fluoroguanosine
  modified_base 12: mod_base = um
  modified_base 13: mod_base = OTHER; note = 2'-fluorouridine
  modified_base 14: mod_base = gm
  modified_base 15: mod_base = OTHER; note = 2'-fluorouridine
  modified_base 16: mod_base = um
  modified_base 17: mod_base = OTHER; note = 2'-fluoroguanosine
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
ggtactccttgttgttgcatt

SEQ ID NO: 252 - RNA, 21 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = gm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
ggtactccttgttgttgcatt

SEQ ID NO: 253 - RNA, 20 nt, synthetic construct
  modified_base 1: mod_base = gm
  modified_base 2: mod_base = gm
  modified_base 3: mod_base = gm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluorocytidine
  modified_base 9: mod_base = OTHER; note = 2'-fluorocytidine
  modified_base 10: mod_base = OTHER; note = 2'-fluorouridine
  modified_base 11: mod_base = um
  modified_base 12: mod_base = gm
  modified_base 13: mod_base = um
  modified_base 14: mod_base = um
  modified_base 15: mod_base = gm
  modified_base 16: mod_base = um
  modified_base 17: mod_base = um
  modified_base 18: mod_base = gm
  modified_base 19: mod_base = cm
  modified_base 20: mod_base = OTHER; note = 2'-O-methyladenosine
  source 1..20: mol_type = other RNA
gggtactccttgttgttgca

SEQ ID NO: 254 - RNA, 21 nt, synthetic construct
  modified_base 1: mod_base = cm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
cgggtactccttgttgttgca

SEQ ID NO: 255 - RNA, 21 nt, synthetic construct
  modified_base 1: mod_base = cm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
cgggtactccttgttgttgca

SEQ ID NO: 256 - RNA, 21 nt, synthetic construct
  modified_base 1: mod_base = gm
  modified_base 2: mod_base = cm
  modified_base 3: mod_base = OTHER; note = 2'-fluorouridine
  modified_base 4: mod_base = gm
  modified_base 5: mod_base = OTHER; note = 2'-fluoroguanosine
  modified_base 6: mod_base = gm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = gm
  modified_base 13: mod_base = OTHER; note = 2'-fluoroadenosine
  modified_base 14: mod_base = um
  modified_base 15: mod_base = OTHER; note = 2'-fluoroguanosine
  modified_base 16: mod_base = gm
  modified_base 17: mod_base = OTHER; note = 2'-fluorocytidine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gctgggtgaccgatggctatt

SEQ ID NO: 257 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = gm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroadenosine
  modified_base 10: mod_base = cm
  modified_base 11: mod_base = cm
  modified_base 12: mod_base = gm
  modified_base 13: mod_base = OTHER; note = 2'-O-methyladenosine
  modified_base 14: mod_base = um
  modified_base 15: mod_base = gm
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gctgggtgaccgatggctatt

SEQ ID NO: 258 - RNA, 20 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluoroadenosine
  modified_base 11: mod_base = cm
  modified_base 12: mod_base = cm
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = gm
  modified_base 18: mod_base = cm
  modified_base 19: mod_base = um
  modified_base 20: mod_base = OTHER; note = 2'-O-methyladenosine
  source 1..20: mol_type = other RNA
ggctgggtgaccgatggcta

SEQ ID NO: 259 - RNA, 21 nt, synthetic construct
  modified_base 1: mod_base = gm
  modified_base 2: mod_base = gm
  modified_base 3: mod_base = gm
  modified_base 4: mod_base = cm
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = gm
  modified_base 19: mod_base = cm
  modified_base 20: mod_base = um
  modified_base 21: mod_base = OTHER; note = 2'-O-methyladenosine
  source 1..21: mol_type = other RNA
gggctgggtgaccgatggcta

SEQ ID NO: 260 - RNA, 21 nt, synthetic construct
  modified_base 1: mod_base = gm
  modified_base 2: mod_base = gm
  modified_base 3: mod_base = gm
  modified_base 4: mod_base = cm
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = gm
  modified_base 19: mod_base = cm
  modified_base 20: mod_base = um
  modified_base 21: mod_base = OTHER; note = 2'-O-methyladenosine
  source 1..21: mol_type = other RNA
gggctgggtgaccgatggcta

SEQ ID NO: 261 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-fluorocytidine
  modified_base 4: mod_base = cm
  modified_base 5: mod_base = OTHER; note = 2'-fluoroguanosine
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = OTHER; note = 2'-fluorocytidine
  modified_base 14: mod_base = OTHER; note = 2'-O-methyladenosine
  modified_base 15: mod_base = OTHER; note = 2'-fluoroguanosine
  modified_base 16: mod_base = um
  modified_base 17: mod_base = OTHER; note = 2'-fluorouridine
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
gaccgatggcttcagttcatt

SEQ ID NO: 262 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = cm
  modified_base 11: mod_base = um
  modified_base 12: mod_base = um
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
gaccgatggcttcagttcatt

SEQ ID NO: 263 - RNA, 20 nt, synthetic construct
  modified_base 1: mod_base = um
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluoroguanosine
  modified_base 11: mod_base = cm
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyladenosine
  source 1..20: mol_type = other RNA
tgaccgatggcttcagttca

SEQ ID NO: 264 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
gtgaccgatggcttcagttca

SEQ ID NO: 265 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
gtgaccgatggcttcagttca

SEQ ID NO: 266 - RNA, 21 nt, synthetic construct
  modified_base 1: mod_base = gm
  modified_base 2: mod_base = cm
  modified_base 3: mod_base = OTHER; note = 2'-fluorouridine
  modified_base 4: mod_base = um
  modified_base 5: mod_base = OTHER; note = 2'-fluorocytidine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorouridine
  modified_base 10: mod_base = cm
  modified_base 11: mod_base = OTHER; note = 2'-fluorocytidine
  modified_base 12: mod_base = cm
  modified_base 13: mod_base = OTHER; note = 2'-fluorouridine
  modified_base 14: mod_base = gm
  modified_base 15: mod_base = OTHER; note = 2'-fluoroadenosine
  modified_base 16: mod_base = OTHER; note = 2'-O-methyladenosine
  modified_base 17: mod_base = OTHER; note = 2'-fluoroadenosine
  modified_base 18: mod_base = gm
  modified_base 19: mod_base = OTHER; note = 2'-O-methyladenosine
  modified_base 20: mod_base = um
  modified_base 21: mod_base = um
  source 1..21: mol_type = other RNA
gcttcagttccctgaaagatt

SEQ ID NO: 267 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorouridine
  modified_base 10: mod_base = cm
  modified_base 11: mod_base = cm
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = um
  modified_base 21: mod_base = um
  source 1..21: mol_type = other RNA
gcttcagttccctgaaagatt

SEQ ID NO: 268 - RNA, 20 nt, synthetic construct
  modified_base 1: mod_base = gm
  modified_base 2: mod_base = gm
  modified_base 3: mod_base = cm
  modified_base 4: mod_base = um
  modified_base 5: mod_base = um
  modified_base 6: mod_base = cm
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-fluorouridine
  modified_base 10: mod_base = OTHER; note = 2'-fluorouridine
  modified_base 11: mod_base = cm
  modified_base 12: mod_base = cm
  modified_base 13: mod_base = cm
  modified_base 14: mod_base = um
  modified_base 15: mod_base = gm
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  source 1..20: mol_type = other RNA
ggcttcagttccctgaaaga

SEQ ID NO: 269 - RNA, 21 nt, synthetic construct
  modified_base 1: mod_base = um
  modified_base 2: mod_base = gm
  modified_base 3: mod_base = gm
  modified_base 4: mod_base = cm
  modified_base 5: mod_base = um
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = cm
  modified_base 14: mod_base = cm
  modified_base 15: mod_base = um
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
tggcttcagttccctgaaaga

SEQ ID NO: 270 - RNA, 21 nt, synthetic construct
  modified_base 1: mod_base = um
  modified_base 2: mod_base = gm
  modified_base 3: mod_base = gm
  modified_base 4: mod_base = cm
  modified_base 5: mod_base = um
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = cm
  modified_base 14: mod_base = cm
  modified_base 15: mod_base = um
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
tggcttcagttccctgaaaga

SEQ ID NO: 271 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-fluorocytidine
  modified_base 4: mod_base = um
  modified_base 5: mod_base = OTHER; note = 2'-fluoroadenosine
  modified_base 6: mod_base = cm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluoroguanosine
  modified_base 12: mod_base = cm
  modified_base 13: mod_base = OTHER; note = 2'-fluoroadenosine
  modified_base 14: mod_base = cm
  modified_base 15: mod_base = OTHER; note = 2'-fluorocytidine
  modified_base 16: mod_base = gm
  modified_base 17: mod_base = OTHER; note = 2'-fluorouridine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gactactggagcaccgttatt

SEQ ID NO: 272 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gactactggagcaccgttatt

SEQ ID NO: 273 - RNA, 20 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methyladenosine
  modified_base 12: mod_base = gm
  modified_base 13: mod_base = cm
  modified_base 14: mod_base = OTHER; note = 2'-O-methyladenosine
  modified_base 15: mod_base = cm
  modified_base 16: mod_base = cm
  modified_base 17: mod_base = gm
  modified_base 18: mod_base = um
  modified_base 19: mod_base = um
  modified_base 20: mod_base = OTHER; note = 2'-O-methyladenosine
  source 1..20: mol_type = other RNA
agactactggagcaccgtta

SEQ ID NO: 274 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = cm
  modified_base 17: mod_base = cm
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
aagactactggagcaccgtta

SEQ ID NO: 275 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = cm
  modified_base 17: mod_base = cm
  modified_base 18: mod_base = gm
  modified_base 19: mod_base = um
  modified_base 20: mod_base = um
  modified_base 21: mod_base = OTHER; note = 2'-O-methyladenosine
  source 1..21: mol_type = other RNA
aagactactggagcaccgtta

SEQ ID NO: 276 - RNA, 21 nt, synthetic construct
  modified_base 1: mod_base = OTHER; note = 2'-O-methyladenosine
  modified_base 2: mod_base = cm
  modified_base 3: mod_base = OTHER; note = 2'-fluorouridine
  modified_base 4: mod_base = OTHER; note = 2'-O-methyladenosine
  modified_base 5: mod_base = OTHER; note = 2'-fluorocytidine
  modified_base 6: mod_base = um
  modified_base 7: mod_base = OTHER; note = 2'-fluoroguanosine
  modified_base 8: mod_base = OTHER; note = 2'-fluoroguanosine
  modified_base 9: mod_base = OTHER; note = 2'-fluoroadenosine
  modified_base 10: mod_base = gm
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-fluorocytidine
  modified_base 14: mod_base = cm
  modified_base 15: mod_base = OTHER; note = 2'-fluoroguanosine
  modified_base 16: mod_base = um
  modified_base 17: mod_base = OTHER; note = 2'-fluorouridine
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
actactggagcaccgttaatt

SEQ ID NO: 277 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluoroguanosine
  modified_base 8: mod_base = OTHER; note = 2'-fluoroguanosine
  modified_base 9: mod_base = OTHER; note = 2'-fluoroadenosine
  modified_base 10: mod_base = gm
  modified_base 11: mod_base = cm
  modified_base 12: mod_base = OTHER; note = 2'-O-methyladenosine
  modified_base 13: mod_base = cm
  modified_base 14: mod_base = cm
  modified_base 15: mod_base = gm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = um
  source 1..21: mol_type = other RNA
actactggagcaccgttaatt

SEQ ID NO: 278 - RNA, 20 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroadenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  source 1..20: mol_type = other RNA
gactactggagcaccgttaa

SEQ ID NO: 279 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = gm
  modified_base 13: mod_base = cm
  modified_base 14: mod_base = OTHER; note = 2'-O-methyladenosine
  modified_base 15: mod_base = cm
  modified_base 16: mod_base = cm
  modified_base 17: mod_base = gm
  modified_base 18: mod_base = um
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
agactactggagcaccgttaa

SEQ ID NO: 280 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = gm
  modified_base 13: mod_base = cm
  modified_base 14: mod_base = OTHER; note = 2'-O-methyladenosine
  modified_base 15: mod_base = cm
  modified_base 16: mod_base = cm
  modified_base 17: mod_base = gm
  modified_base 18: mod_base = um
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
agactactggagcaccgttaa

SEQ ID NO: 281 - RNA, 21 nt, synthetic construct
  modified_base 1: mod_base = gm
  modified_base 2: mod_base = cm
  modified_base 3: mod_base = OTHER; note = 2'-fluoroadenosine
  modified_base 4: mod_base = cm
  modified_base 5: mod_base = OTHER; note = 2'-fluorocytidine
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = OTHER; note = 2'-fluoroguanosine
  modified_base 12: mod_base = gm
  modified_base 13: mod_base = OTHER; note = 2'-fluoroadenosine
  modified_base 14: mod_base = cm
  modified_base 15: mod_base = OTHER; note = 2'-fluoroadenosine
  modified_base 16: mod_base = OTHER; note = 2'-O-methyladenosine
  modified_base 17: mod_base = OTHER; note = 2'-fluoroguanosine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gcaccgttaaggacaagtatt

SEQ ID NO: 282 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gcaccgttaaggacaagtatt

SEQ ID NO: 283 - RNA, 20 nt, synthetic construct
  modified_base 1: mod_base = OTHER; note = 2'-O-methyladenosine
  modified_base 2: mod_base = gm
  modified_base 3: mod_base = cm
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-fluorouridine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-O-methyladenosine
  modified_base 12: mod_base = gm
  modified_base 13: mod_base = gm
  modified_base 14: mod_base = OTHER; note = 2'-O-methyladenosine
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  source 1..20: mol_type = other RNA
agcaccgttaaggacaagta

SEQ ID NO: 284 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
gagcaccgttaaggacaagta

SEQ ID NO: 285 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
gagcaccgttaaggacaagta

SEQ ID NO: 286 - RNA, 21 nt, synthetic construct
  modified_base 1: mod_base = OTHER; note = 2'-O-methyladenosine
  modified_base 2: mod_base = cm
  modified_base 3: mod_base = OTHER; note = 2'-fluorocytidine
  modified_base 4: mod_base = gm
  modified_base 5: mod_base = OTHER; note = 2'-fluorouridine
  modified_base 6: mod_base = um
  modified_base 7: mod_base = OTHER; note = 2'-fluoroadenosine
  modified_base 8: mod_base = OTHER; note = 2'-fluoroadenosine
  modified_base 9: mod_base = OTHER; note = 2'-fluoroguanosine
  modified_base 10: mod_base = gm
  modified_base 11: mod_base = OTHER; note = 2'-fluoroadenosine
  modified_base 12: mod_base = cm
  modified_base 13: mod_base = OTHER; note = 2'-fluoroadenosine
  modified_base 14: mod_base = OTHER; note = 2'-O-methyladenosine
  modified_base 15: mod_base = OTHER; note = 2'-fluoroguanosine
  modified_base 16: mod_base = um
  modified_base 17: mod_base = OTHER; note = 2'-fluorouridine
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
accgttaaggacaagttcatt

SEQ ID NO: 287 - RNA, 21 nt, synthetic construct
  modified_base 1: mod_base = OTHER; note = 2'-O-methyladenosine
  modified_base 2: mod_base = cm
  modified_base 3: mod_base = cm
  modified_base 4: mod_base = gm
  modified_base 5: mod_base = um
  modified_base 6: mod_base = um
  modified_base 7: mod_base = OTHER; note = 2'-fluoroadenosine
  modified_base 8: mod_base = OTHER; note = 2'-fluoroadenosine
  modified_base 9: mod_base = OTHER; note = 2'-fluoroguanosine
  modified_base 10: mod_base = gm
  modified_base 11: mod_base = OTHER; note = 2'-O-methyladenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
accgttaaggacaagttcatt

SEQ ID NO: 288 - RNA, 20 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = um
  modified_base 7: mod_base = um
  modified_base 8: mod_base = OTHER; note = 2'-fluoroadenosine
  modified_base 9: mod_base = OTHER; note = 2'-fluoroadenosine
  modified_base 10: mod_base = OTHER; note = 2'-fluoroguanosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = OTHER; note = 2'-O-methyladenosine
  source 1..20: mol_type = other RNA
caccgttaaggacaagttca

SEQ ID NO: 289 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
gcaccgttaaggacaagttca

SEQ ID NO: 290 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
gcaccgttaaggacaagttca

SEQ ID NO: 291 - RNA, 21 nt, synthetic construct
  modified_base 1: mod_base = cm
  modified_base 2: mod_base = cm
  modified_base 3: mod_base = OTHER; note = 2'-fluoroguanosine
  modified_base 4: mod_base = um
  modified_base 5: mod_base = OTHER; note = 2'-fluorouridine
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-fluoroadenosine
  modified_base 14: mod_base = gm
  modified_base 15: mod_base = OTHER; note = 2'-fluorouridine
  modified_base 16: mod_base = um
  modified_base 17: mod_base = OTHER; note = 2'-fluorocytidine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
ccgttaaggacaagttctatt

SEQ ID NO: 292 - RNA, 21 nt, synthetic construct
  modified_base 1: mod_base = cm
  modified_base 2: mod_base = cm
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = cm
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
ccgttaaggacaagttctatt

SEQ ID NO: 293 - RNA, 20 nt, synthetic construct
  modified_base 1: mod_base = OTHER; note = 2'-O-methyladenosine
  modified_base 2: mod_base = cm
  modified_base 3: mod_base = cm
  modified_base 4: mod_base = gm
  modified_base 5: mod_base = um
  modified_base 6: mod_base = um
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methyladenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  modified_base 19: mod_base = um
  modified_base 20: mod_base = OTHER; note = 2'-O-methyladenosine
  source 1..20: mol_type = other RNA
accgttaaggacaagttcta

SEQ ID NO: 294 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
caccgttaaggacaagttcta

SEQ ID NO: 295 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
caccgttaaggacaagttcta

SEQ ID NO: 296 - RNA, 21 nt, synthetic construct
  modified_base 1: mod_base = cm
  modified_base 2: mod_base = cm
  modified_base 3: mod_base = OTHER; note = 2'-fluorouridine
  modified_base 4: mod_base = cm
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluorocytidine
  modified_base 10: mod_base = cm
  modified_base 11: mod_base = OTHER; note = 2'-fluorocytidine
  modified_base 12: mod_base = cm
  modified_base 13: mod_base = OTHER; note = 2'-fluoroadenosine
  modified_base 14: mod_base = OTHER; note = 2'-O-methyladenosine
  modified_base 15: mod_base = OTHER; note = 2'-fluoroguanosine
  modified_base 16: mod_base = um
  modified_base 17: mod_base = OTHER; note = 2'-fluorocytidine
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
cctcaataccccaagtccatt

SEQ ID NO: 297 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluorocytidine
  modified_base 10: mod_base = cm
  modified_base 11: mod_base = cm
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
cctcaataccccaagtccatt

SEQ ID NO: 298 - RNA, 20 nt, synthetic construct
  modified_base 1: mod_base = OTHER; note = 2'-O-methyladenosine
  modified_base 2: mod_base = cm
  modified_base 3: mod_base = cm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-fluorocytidine
  modified_base 11: mod_base = cm
  modified_base 12: mod_base = cm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = cm
  modified_base 19: mod_base = cm
  modified_base 20: mod_base = OTHER; note = 2'-O-methyladenosine
  source 1..20: mol_type = other RNA
acctcaataccccaagtcca

SEQ ID NO: 299 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
gacctcaataccccaagtcca

SEQ ID NO: 300 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
gacctcaataccccaagtcca

SEQ ID NO: 301 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-fluoroadenosine
  modified_base 4: mod_base = OTHER; note = 2'-O-methyladenosine
  modified_base 5: mod_base = OTHER; note = 2'-fluoroguanosine
  modified_base 6: mod_base = gm
  modified_base 7: mod_base = OTHER; note = 2'-fluoroguanosine
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = OTHER; note = 2'-fluoroadenosine
  modified_base 14: mod_base = um
  modified_base 15: mod_base = OTHER; note = 2'-fluorouridine
  modified_base 16: mod_base = cm
  modified_base 17: mod_base = OTHER; note = 2'-fluorouridine
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
aaaagggacagtattctcatt

SEQ ID NO: 302 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = gm
  modified_base 7: mod_base = OTHER; note = 2'-fluoroguanosine
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
aaaagggacagtattctcatt

SEQ ID NO: 303 - RNA, 20 nt, synthetic construct
  modified_base 1: mod_base = um
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-fluoroguanosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-O-methyladenosine
  modified_base 12: mod_base = gm
  modified_base 13: mod_base = um
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = um
  modified_base 19: mod_base = cm
  modified_base 20: mod_base = OTHER; note = 2'-O-methyladenosine
  source 1..20: mol_type = other RNA
taaaagggacagtattctca

SEQ ID NO: 304 - RNA, 21 nt, synthetic construct
  modified_base 1: mod_base = um
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ttaaaagggacagtattctca

SEQ ID NO: 305 - RNA, 21 nt, synthetic construct
  modified_base 1: mod_base = um
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ttaaaagggacagtattctca

SEQ ID NO: 306 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-fluoroguanosine
  modified_base 4: mod_base = gm
  modified_base 5: mod_base = OTHER; note = 2'-fluoroadenosine
  modified_base 6: mod_base = cm
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorouridine
  modified_base 12: mod_base = um
  modified_base 13: mod_base = OTHER; note = 2'-fluorocytidine
  modified_base 14: mod_base = um
  modified_base 15: mod_base = OTHER; note = 2'-fluorocytidine
  modified_base 16: mod_base = OTHER; note = 2'-O-methyladenosine
  modified_base 17: mod_base = OTHER; note = 2'-fluoroguanosine
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
agggacagtattctcagtatt

SEQ ID NO: 307 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluorouridine
  modified_base 10: mod_base = OTHER; note = 2'-O-methyladenosine
  modified_base 11: mod_base = um
  modified_base 12: mod_base = um
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = gm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
agggacagtattctcagtatt

SEQ ID NO: 308 - RNA, 20 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-fluoroadenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-O-methyladenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  source 1..20: mol_type = other RNA
aagggacagtattctcagta

SEQ ID NO: 309 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = um
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
aaagggacagtattctcagta

SEQ ID NO: 310 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = um
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
aaagggacagtattctcagta

SEQ ID NO: 311 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tacttgtccttaacggtgctt

SEQ ID NO: 312 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = cm
  source 1..21: mol_type = other RNA
tacttgtccttaacggtgctc

SEQ ID NO: 313 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
aacttgtccttaacggtgctt

SEQ ID NO: 314 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tggacttggggtattgaggtt

SEQ ID NO: 315 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = cm
  source 1..21: mol_type = other RNA
tggacttggggtattgaggtc

SEQ ID NO: 316 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tctttcagggaactgaagctt

SEQ ID NO: 317 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
tctttcagggaactgaagcct

SEQ ID NO: 318 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tgaactgaagccatcggtctt

SEQ ID NO: 319 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgaactgaagccatcggtcac

SEQ ID NO: 320 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
tgagaatactgtcccttttgg

SEQ ID NO: 321 - RNA, 22 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = gm
  modified_base 21: mod_base = cm
  modified_base 21^22: mod_base = OTHER; note = phosphorothioate linkage
  modified_base 22: mod_base = gm
  source 1..22: mol_type = other RNA
tgagaatactgtcccttttgcg

SEQ ID NO: 322 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
taacggtgctccagtagtctt

SEQ ID NO: 323 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = gm
  modified_base 6: mod_base = OTHER; note = 2'-fluoroguanosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = cm
  modified_base 20: mod_base = gm
  modified_base 20^21: mod_base = OTHER; note = phosphorothioate linkage
  modified_base 21: mod_base = um
  source 1..21: mol_type = other RNA
taacggtgctccagtagtcgt

SEQ ID NO: 324 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
tactgagaatactgtcccttt

SEQ ID NO: 325 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = um
  modified_base 20: mod_base = gm
  modified_base 20^21: mod_base = OTHER; note = phosphorothioate linkage
  modified_base 21: mod_base = um
  source 1..21: mol_type = other RNA
tactgagaatactgtccctgt

SEQ ID NO: 326 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
ttaacggtgctccagtagtct

SEQ ID NO: 327 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroguanosine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluorocytidine
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = cm
  modified_base 20^21: mod_base = OTHER; note = phosphorothioate linkage
  modified_base 21: mod_base = um
  source 1..21: mol_type = other RNA
ttaacggtgctccagtaggct

SEQ ID NO: 328 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tagccatcggtcacccagctt

SEQ ID NO: 329 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
aagccatcggtcacccagctt

SEQ ID NO: 330 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tagaacttgtccttaacggtt

SEQ ID NO: 331 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = gm
  source 1..21: mol_type = other RNA
tagaacttgtccttaacggtg

SEQ ID NO: 332 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
tgaacttgtccttaacggttt

SEQ ID NO: 333 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
agaacttgtccttaacggttt

SEQ ID NO: 334 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
tgaacttgtccttaacggtgc

SEQ ID NO: 335 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tgcaacaacaaggagtacctt

SEQ ID NO: 336 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 20^21: mod_base = OTHER; note = phosphorothioate linkage
  modified_base 21: mod_base = gm
  source 1..21: mol_type = other RNA
tgcaacaacaaggagtacccg

SEQ ID NO: 337 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = gm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
taacaacaaggagtacccgtt

SEQ ID NO: 338 - RNA, 22 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = gm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = cm
  modified_base 20: mod_base = cm
  modified_base 21: mod_base = um
  modified_base 21^22: mod_base = OTHER; note = phosphorothioate linkage
  modified_base 22: mod_base = um
  source 1..22: mol_type = other RNA
tgcactgagaatactgtccctt

SEQ ID NO: 339 - RNA, 22 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = gm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = cm
  modified_base 20: mod_base = cm
  modified_base 21: mod_base = um
  modified_base 21^22: mod_base = OTHER; note = phosphorothioate linkage
  modified_base 22: mod_base = um
  source 1..22: mol_type = other RNA
agcactgagaatactgtccctt

SEQ ID NO: 340 - RNA, 22 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = um
  source 1..22: mol_type = other RNA
ctacttgtccttaacggtgctt

SEQ ID NO: 341 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = cm
  source 1..21: mol_type = other RNA
aacttgtccttaacggtgctc

SEQ ID NO: 342 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 19: mod_base = cm
  source 1..19: mol_type = other RNA
tacttgtccttaacggtgc

SEQ ID NO: 343 - RNA, 22 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  modified_base 21^22: mod_base = OTHER; note = phosphorothioate linkage
  modified_base 22: mod_base = cm
  source 1..22: mol_type = other RNA
tacttgtccttaacggtgctcc

SEQ ID NO: 344 - RNA, 23 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  modified_base 22: mod_base = um
  modified_base 22^23: mod_base = OTHER; note = phosphorothioate linkage
  modified_base 23: mod_base = um
  source 1..23: mol_type = other RNA
tacttgtccttaacggtgctctt

SEQ ID NO: 345 - RNA, 23 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  modified_base 22: mod_base = cm
  modified_base 22^23: mod_base = OTHER; note = phosphorothioate linkage
  modified_base 23: mod_base = OTHER; note = 2'-O-methyladenosine
  source 1..23: mol_type = other RNA
tacttgtccttaacggtgctcca

SEQ ID NO: 346 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = gm
  modified_base 18^19: mod_base = OTHER; note = phosphorothioate linkage
  modified_base 19: mod_base = cm
  source 1..19: mol_type = other RNA
aacttgtccttaacggtgc

SEQ ID NO: 347 - RNA, 22 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = um
  modified_base 21: mod_base = cm
  modified_base 21^22: mod_base = OTHER; note = phosphorothioate linkage
  modified_base 22: mod_base = cm
  source 1..22: mol_type = other RNA
aacttgtccttaacggtgctcc

SEQ ID NO: 348 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
tgagaatactgtccctttttt

SEQ ID NO: 349 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = um
  source 1..21: mol_type = other RNA
tgagaatactgtcccttttgt

SEQ ID NO: 350 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
tgagaatactgtcccttttgg

SEQ ID NO: 351 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
agagaatactgtcccttttgg

SEQ ID NO: 352 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 18^19: mod_base = OTHER; note = phosphorothioate linkage
  modified_base 19: mod_base = cm
  source 1..19: mol_type = other RNA
tgcaacaacaaggagtacc

SEQ ID NO: 353 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
tgcaacaacaaggagtaccct

SEQ ID NO: 354 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tgcaacaacaaggagtacctt

SEQ ID NO: 355 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tgcaacaacaaggagtacctt

SEQ ID NO: 356 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 3: mod_base = cm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tgcaacaacaaggagtacctt

SEQ ID NO: 357 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
agcaacaacaaggagtacctt

SEQ ID NO: 358 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = gm
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
tctgaagccatcggtcaccca

SEQ ID NO: 359 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = gm
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluoroguanosine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
actgaagccatcggtcaccca

SEQ ID NO: 360 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
tggaactgaagccatcggtca

SEQ ID NO: 361 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = gm
  modified_base 18: mod_base = OTHER; note = 2'-fluoroguanosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tggaactgaagccatcggtcc

SEQ ID NO: 362 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = cm
  modified_base 8: mod_base = OTHER; note = 2'-O-methyladenosine
  modified_base 9: mod_base = gm
  modified_base 10: mod_base = gm
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroadenosine
  modified_base 19: mod_base = gm
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
ttctttcagggaactgaagcc

SEQ ID NO: 363 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = gm
  modified_base 8: mod_base = gm
  modified_base 9: mod_base = um
  modified_base 10: mod_base = gm
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tttaacggtgctccagtagtc

SEQ ID NO: 364 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = gm
  modified_base 10: mod_base = gm
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tccttaacggtgctccagtag

SEQ ID NO: 365 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = gm
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = OTHER; note = 2'-O-methyladenosine
  source 1..21: mol_type = other RNA
ttccttaacggtgctccagta

SEQ ID NO: 366 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = cm
  modified_base 10: mod_base = gm
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
ttccttaacggtgctccagtc

SEQ ID NO: 367 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tacttgtccttaacggtgctc

SEQ ID NO: 368 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = cm
  modified_base 19^20: mod_base = OTHER; note = phosphorothioate linkage
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
aacttgtccttaacggtgctc

SEQ ID NO: 369 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroguanosine
  modified_base 7: mod_base = um
  modified_base 8: mod_base = cm
  modified_base 9: mod_base = um
  modified_base 10: mod_base = cm
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
ttgaggtctcaggcagccact

SEQ ID NO: 370 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluoroguanosine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
ttattgaggtctcaggcagcc

SEQ ID NO: 371 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = gm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tgtattgaggtctcaggcagc

SEQ ID NO: 372 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-O-methyladenosine
  modified_base 10: mod_base = OTHER; note = 2'-fluoroadenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = um
  source 1..21: mol_type = other RNA
tcactgagaatactgtccctt

SEQ ID NO: 373 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = um
  source 1..21: mol_type = other RNA
tcactgagaatactgtccctt

SEQ ID NO: 374 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroadenosine
  modified_base 9: mod_base = gm
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluoroadenosine
  modified_base 13: mod_base = cm
  modified_base 14: mod_base = OTHER; note = 2'-fluorocytidine
  modified_base 15: mod_base = um
  modified_base 16: mod_base = OTHER; note = 2'-fluoroadenosine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tcttttaagcaacctacaggg

SEQ ID NO: 375 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tgagaatactgtcccttttcc

SEQ ID NO: 376 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = gm
  modified_base 10: mod_base = um
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
ttattgaggtctcaggcagcc

SEQ ID NO: 377 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tgagaatactgtcccttttcc

SEQ ID NO: 378 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
tgagaatactgtcccttttct

SEQ ID NO: 379 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
ttcttgtccagctttattggg

SEQ ID NO: 380 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tagtctttcagggaactgaag

SEQ ID NO: 381 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
tagtctttcagggaactgaac

SEQ ID NO: 382 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = um
  modified_base 20^21: mod_base = OTHER; note = phosphorothioate linkage
  modified_base 21: mod_base = um
  source 1..21: mol_type = other RNA
tcactgagaatactgtccctt

SEQ ID NO: 383 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tcactgagaatactgtccgtt

SEQ ID NO: 384 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = gm
  source 1..21: mol_type = other RNA
tagtctttcagggaactgacg

SEQ ID NO: 385 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tagtctttcagggaactgagg

SEQ ID NO: 386 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tagtctttcagggaactgacc

SEQ ID NO: 387 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tagtctttcagggaactgagc

SEQ ID NO: 388 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
agaatactgtcccttttaggc

SEQ ID NO: 389 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
agaatactgtcccttttaagg

SEQ ID NO: 390 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2',3'-seco-adenosine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
tgcaacaacaaggagtaccct

SEQ ID NO: 391 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = OTHER; note = 2',3'-seco-uridine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tagtctttcagggaactgaag

SEQ ID NO: 392 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = OTHER; note = 2',3'-seco-cytidine
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
agaatactgtcccttttaagc

SEQ ID NO: 393 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroadenosine
  modified_base 7: mod_base = OTHER; note = 2',3'-seco-uridine
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = gm
  modified_base 20: mod_base = cm
  modified_base 20^21: mod_base = OTHER; note = phosphorothioate linkage
  modified_base 21: mod_base = cm
  source 1..21: mol_type = other RNA
tgagaatactgtccctttgcc

SEQ ID NO: 394 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2',3'-seco-adenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcactgagaatactgtccctc

SEQ ID NO: 395 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'3'-seco-uridine
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
ttcttgtccagctttattggc

SEQ ID NO: 396 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = um
  source 1..21: mol_type = other RNA
agaatactgtcccttttaggt

SEQ ID NO: 397 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = cm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
agaatactgtcccttttacgc

SEQ ID NO: 398 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
agaatactgtcccttttagac

SEQ ID NO: 399 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = gm
  modified_base 10: mod_base = um
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
agaatactgtcccttttaggc

SEQ ID NO: 400 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = um
  modified_base 5: mod_base = um
  modified_base 6: mod_base = gm
  modified_base 7: mod_base = um
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
ttcttgtccagctttattggc

SEQ ID NO: 401 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tcactgagaatactgtccctg

SEQ ID NO: 402 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
tcactgagaatactgtcccct

SEQ ID NO: 403 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'3'-seco-adenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcactgagaatactgtccctc

SEQ ID NO: 404 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2',3'-seco-cytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcactgagaatactgtccctc

SEQ ID NO: 405 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2',3'-seco-uridine
  modified_base 6: mod_base = OTHER; note = 2'-fluoroguanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcactgagaatactgtccctc

SEQ ID NO: 406 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2',3'-seco-guanosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcactgagaatactgtccctc

SEQ ID NO: 407 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluoroadenosine
  modified_base 7: mod_base = um
  modified_base 8: mod_base = cm
  modified_base 9: mod_base = cm
  modified_base 10: mod_base = um
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
agtgcatccttggcggtcttt

SEQ ID NO: 408 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluoroadenosine
  modified_base 7: mod_base = OTHER; note = 2',3'-seco-uridine
  modified_base 8: mod_base = cm
  modified_base 9: mod_base = cm
  modified_base 10: mod_base = um
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorocytidine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = um
  source 1..21: mol_type = other RNA
agtgcatccttggcggtcttt

SEQ ID NO: 409 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = cm
  modified_base 8: mod_base = um
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroguanosine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluorocytidine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
agtagtctttcagggaactga

SEQ ID NO: 410 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = OTHER; note = 2',3'-seco-cytidine
  modified_base 8: mod_base = um
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroguanosine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluorocytidine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
agtagtctttcagggaactga

SEQ ID NO: 411 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = cm
  modified_base 8: mod_base = um
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroguanosine
  modified_base 15: mod_base = gm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluorocytidine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
tgtagtctttcagggaactga

SEQ ID NO: 412 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = gm
  modified_base 9: mod_base = gm
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = gm
  modified_base 18: mod_base = OTHER; note = 2'-fluorouridine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = um
  source 1..21: mol_type = other RNA
tcttaacggtgctccagtagt

SEQ ID NO: 413 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = cm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tccttttaagcaacctacagg

SEQ ID NO: 414 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = cm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tccttttaagcaacctacagc

SEQ ID NO: 415 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tagtctttcagggaactgacc

SEQ ID NO: 416 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
gcaccgttaaggacaagtatt

SEQ ID NO: 417 - RNA, 20 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  source 1..20: mol_type = other RNA
gagcaccgttaaggacaagt

SEQ ID NO: 418 - RNA, 18 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  source 1..18: mol_type = other RNA
gcaccgttaaggacaagt

SEQ ID NO: 419 - RNA, 19 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  source 1..19: mol_type = other RNA
gcaccgttaaggacaagtt

SEQ ID NO: 420 - RNA, 18 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroadenosine
  modified_base 9: mod_base = OTHER; note = 2'-fluorocytidine
  modified_base 10: mod_base = cm
  modified_base 11: mod_base = cm
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = cm
  modified_base 18: mod_base = cm
  source 1..18: mol_type = other RNA
cctcaataccccaagtcc

SEQ ID NO: 421 - RNA, 20 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = cm
  modified_base 20: mod_base = cm
  source 1..20: mol_type = other RNA
gacctcaataccccaagtcc

SEQ ID NO: 422 - RNA, 18 nt, synthetic construct
  modified_base 1: mod_base = gm
  modified_base 2: mod_base = cm
  modified_base 3: mod_base = um
  modified_base 4: mod_base = um
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorouridine
  modified_base 10: mod_base = cm
  modified_base 11: mod_base = cm
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  source 1..18: mol_type = other RNA
gcttcagttccctgaaag

SEQ ID NO: 423 - RNA, 19 nt, synthetic construct
  modified_base 1: mod_base = gm
  modified_base 2: mod_base = gm
  modified_base 3: mod_base = cm
  modified_base 4: mod_base = um
  modified_base 5: mod_base = um
  modified_base 6: mod_base = cm
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-fluorouridine
  modified_base 10: mod_base = OTHER; note = 2'-fluorouridine
  modified_base 11: mod_base = cm
  modified_base 12: mod_base = cm
  modified_base 13: mod_base = cm
  modified_base 14: mod_base = um
  modified_base 15: mod_base = gm
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = gm
  source 1..19: mol_type = other RNA
ggcttcagttccctgaaag

SEQ ID NO: 424 - RNA, 18 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = cm
  modified_base 11: mod_base = um
  modified_base 12: mod_base = um
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  source 1..18: mol_type = other RNA
gaccgatggcttcagttc

SEQ ID NO: 425 - RNA, 20 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  source 1..20: mol_type = other RNA
gtgaccgatggcttcagttc

SEQ ID NO: 426 - RNA, 20 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  source 1..20: mol_type = other RNA
ccaaaagggacagtattctc

SEQ ID NO: 427 - RNA, 21 nt, synthetic construct
  modified_base 1: mod_base = cm
  modified_base 1^2: mod_base = OTHER; note = phosphorothioate linkage
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = gm
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-fluorocytidine
  modified_base 13: mod_base = OTHER; note = 2'-O-methyladenosine
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = cm
  source 1..21: mol_type = other RNA
cgcaaaagggacagtattctc

SEQ ID NO: 428 - RNA, 18 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  source 1..18: mol_type = other RNA
gactactggagcaccgtt

SEQ ID NO: 429 - RNA, 18 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = gm
  modified_base 17: mod_base = um
  modified_base 18: mod_base = um
  source 1..18: mol_type = other RNA
gactactggagcactgtt

SEQ ID NO: 430 - RNA, 19 nt, synthetic construct
  modified_base 1: mod_base = cm
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = OTHER; note = 2'-fluorouridine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methyladenosine
  modified_base 12: mod_base = gm
  modified_base 13: mod_base = cm
  modified_base 14: mod_base = OTHER; note = 2'-O-methyladenosine
  modified_base 15: mod_base = cm
  modified_base 16: mod_base = cm
  modified_base 17: mod_base = gm
  modified_base 18: mod_base = um
  modified_base 19: mod_base = um
  source 1..19: mol_type = other RNA
cgactactggagcaccgtt

SEQ ID NO: 431 - RNA, 18 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = gm
  modified_base 12: mod_base = cm
  modified_base 13: mod_base = OTHER; note = 2'-O-methyladenosine
  modified_base 14: mod_base = um
  modified_base 15: mod_base = cm
  modified_base 16: mod_base = gm
  modified_base 17: mod_base = um
  modified_base 18: mod_base = um
  source 1..18: mol_type = other RNA
gactactggagcatcgtt

SEQ ID NO: 432 - RNA, 18 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = OTHER; note = 2'-O-methyladenosine
  modified_base 6: mod_base = cm
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluorouridine
  modified_base 10: mod_base = OTHER; note = 2'-O-methyladenosine
  modified_base 11: mod_base = um
  modified_base 12: mod_base = um
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = gm
  modified_base 18: mod_base = um
  source 1..18: mol_type = other RNA
agggacagtattctcagt

SEQ ID NO: 433 - RNA, 19 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-fluoroadenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-O-methyladenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  source 1..19: mol_type = other RNA
cagggacagtattctcagt

SEQ ID NO: 434 - RNA, 19 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroadenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  modified_base 19: mod_base = OTHER; note = 2'-O-methyladenosine
  source 1..19: mol_type = other RNA
gactactggagcaccgtta

SEQ ID NO: 435 - RNA, 19 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroadenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  modified_base 19: mod_base = OTHER; note = 2'-O-methyladenosine
  source 1..19: mol_type = other RNA
gcctactggagcaccgtta

SEQ ID NO: 436 - RNA, 19 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-fluoroadenosine
  modified_base 11: mod_base = gm
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = gm
  modified_base 17: mod_base = um
  modified_base 18: mod_base = um
  modified_base 19: mod_base = OTHER; note = 2'-O-methyladenosine
  source 1..19: mol_type = other RNA
gcctactggagcactgtta

SEQ ID NO: 437 - RNA, 18 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = gm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroadenosine
  modified_base 10: mod_base = cm
  modified_base 11: mod_base = cm
  modified_base 12: mod_base = gm
  modified_base 13: mod_base = OTHER; note = 2'-O-methyladenosine
  modified_base 14: mod_base = um
  modified_base 15: mod_base = gm
  modified_base 16: mod_base = gm
  modified_base 17: mod_base = cm
  modified_base 18: mod_base = um
  source 1..18: mol_type = other RNA
gctgggtgaccgatggct

SEQ ID NO: 438 - RNA, 19 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = gm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroadenosine
  modified_base 10: mod_base = cm
  modified_base 11: mod_base = cm
  modified_base 12: mod_base = gm
  modified_base 13: mod_base = OTHER; note = 2'-O-methyladenosine
  modified_base 14: mod_base = um
  modified_base 15: mod_base = gm
  modified_base 16: mod_base = gm
  modified_base 17: mod_base = cm
  modified_base 18: mod_base = um
  modified_base 19: mod_base = um
  source 1..19: mol_type = other RNA
gctgggtgaccgatggctt

SEQ ID NO: 439 - RNA, 18 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = gm
  modified_base 7: mod_base = OTHER; note = 2'-fluorouridine
  modified_base 8: mod_base = OTHER; note = 2'-fluoroguanosine
  modified_base 9: mod_base = OTHER; note = 2'-fluoroadenosine
  modified_base 10: mod_base = cm
  modified_base 11: mod_base = cm
  modified_base 12: mod_base = gm
  modified_base 13: mod_base = OTHER; note = 2'-O-methyladenosine
  modified_base 14: mod_base = um
  modified_base 15: mod_base = gm
  modified_base 16: mod_base = OTHER; note = 2'-O-methyladenosine
  modified_base 17: mod_base = cm
  modified_base 18: mod_base = um
  source 1..18: mol_type = other RNA
gctgggtgaccgatgact

SEQ ID NO: 440 - RNA, 18 nt, synthetic construct
  modified_base 1: mod_base = cm
  modified_base 2: mod_base = cm
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-fluoroguanosine
  modified_base 9: mod_base = OTHER; note = 2'-fluoroguanosine
  modified_base 10: mod_base = OTHER; note = 2'-O-methyladenosine
  modified_base 11: mod_base = cm
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = um
  source 1..18: mol_type = other RNA
ccgttaaggacaagttct

SEQ ID NO: 441 - RNA, 20 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = um
  source 1..20: mol_type = other RNA
caccgttaaggacaagttct

SEQ ID NO: 442 - RNA, 18 nt, synthetic construct
  modified_base 1: mod_base = OTHER; note = 2'-O-methyladenosine
  modified_base 2: mod_base = cm
  modified_base 3: mod_base = cm
  modified_base 4: mod_base = gm
  modified_base 5: mod_base = um
  modified_base 6: mod_base = um
  modified_base 7: mod_base = OTHER; note = 2'-fluoroadenosine
  modified_base 8: mod_base = OTHER; note = 2'-fluoroadenosine
  modified_base 9: mod_base = OTHER; note = 2'-fluoroguanosine
  modified_base 10: mod_base = gm
  modified_base 11: mod_base = OTHER; note = 2'-O-methyladenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  source 1..18: mol_type = other RNA
accgttaaggacaagttc

SEQ ID NO: 443 - RNA, 19 nt, synthetic construct
  modified_base 1: mod_base = OTHER; note = 2'-O-methyladenosine
  modified_base 2: mod_base = cm
  modified_base 3: mod_base = cm
  modified_base 4: mod_base = gm
  modified_base 5: mod_base = um
  modified_base 6: mod_base = um
  modified_base 7: mod_base = OTHER; note = 2'-fluoroadenosine
  modified_base 8: mod_base = OTHER; note = 2'-fluoroadenosine
  modified_base 9: mod_base = OTHER; note = 2'-fluoroguanosine
  modified_base 10: mod_base = gm
  modified_base 11: mod_base = OTHER; note = 2'-O-methyladenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = um
  modified_base 17: mod_base = um
  modified_base 18: mod_base = cm
  modified_base 19: mod_base = um
  source 1..19: mol_type = other RNA
accgttaaggacaagttct

SEQ ID NO: 444 - RNA, 20 nt, synthetic construct
  modified_base 1: mod_base = gm
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  source 1..20: mol_type = other RNA
gcaccgttaaggacaagttc

SEQ ID NO: 445 - RNA, 18 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = gm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = cm
  source 1..18: mol_type = other RNA
ggtactccttgttgttgc

SEQ ID NO: 446 - RNA, 20 nt, synthetic construct
  modified_base 1: mod_base = cm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  source 1..20: mol_type = other RNA
cgggtactccttgttgttgc

SEQ ID NO: 447 - RNA, 18 nt, synthetic construct
  modified_base 1: mod_base = cm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = OTHER; note = 2'-fluorouridine
  modified_base 9: mod_base = OTHER; note = 2'-fluorocytidine
  modified_base 10: mod_base = cm
  modified_base 11: mod_base = um
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  source 1..18: mol_type = other RNA
cgggtactccttgttgtt

SEQ ID NO: 448 - RNA, 19 nt, synthetic construct
  modified_base 1: mod_base = gm
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-fluorouridine
  modified_base 9: mod_base = OTHER; note = 2'-fluoroadenosine
  modified_base 10: mod_base = OTHER; note = 2'-fluorouridine
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = cm
  source 1..19: mol_type = other RNA
gggacagtattctcagtgc

SEQ ID NO: 449 - RNA, 20 nt, synthetic construct
  modified_base 1: mod_base = gm
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-fluorouridine
  modified_base 9: mod_base = OTHER; note = 2'-fluoroadenosine
  modified_base 10: mod_base = OTHER; note = 2'-fluorouridine
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = cm
  modified_base 20: mod_base = um
  source 1..20: mol_type = other RNA
gggacagtattctcagtgct

SEQ ID NO: 450 - RNA, 21 nt, synthetic construct
  modified_base 1: mod_base = gm
  modified_base 1^2: mod_base = OTHER; note = phosphorothioate linkage
  modified_base 2: mod_base = cm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorouridine
  modified_base 8: mod_base = OTHER; note = 2'-fluorouridine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = um
  modified_base 21: mod_base = um
  source 1..21: mol_type = other RNA
gcaccgttaaggacaagtttt

SEQ ID NO: 451 - RNA, 20 nt, synthetic construct
  modified_base 1: mod_base = gm
  modified_base 1^2: mod_base = OTHER; note = phosphorothioate linkage
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  source 1..20: mol_type = other RNA
gagcaccgttaaggacaagt

SEQ ID NO: 452 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = cm
  modified_base 9: mod_base = gm
  modified_base 10: mod_base = OTHER; note = 2'-fluorouridine
  modified_base 11: mod_base = OTHER; note = 2'-fluorouridine
  modified_base 12: mod_base = OTHER; note = 2'-fluoroadenosine
  modified_base 13: mod_base = OTHER; note = 2'-O-methyladenosine
  modified_base 14: mod_base = gm
  modified_base 15: mod_base = gm
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = um
  source 1..21: mol_type = other RNA
ggagcaccgttaaggacaagt

SEQ ID NO: 453 - RNA, 21 nt, synthetic construct
  modified_base 1: mod_base = gm
  modified_base 1^2: mod_base = OTHER; note = phosphorothioate linkage
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  modified_base 21: mod_base = um
  source 1..21: mol_type = other RNA
gagcaccgttaaggacaagtt

SEQ ID NO: 454 - RNA, 22 nt, synthetic construct
  modified_base 1: mod_base = gm
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = cm
  modified_base 9: mod_base = gm
  modified_base 10: mod_base = OTHER; note = 2'-fluorouridine
  modified_base 11: mod_base = OTHER; note = 2'-fluorouridine
  modified_base 12: mod_base = OTHER; note = 2'-fluoroadenosine
  modified_base 13: mod_base = OTHER; note = 2'-O-methyladenosine
  modified_base 14: mod_base = gm
  modified_base 15: mod_base = gm
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = um
  modified_base 22: mod_base = um
  source 1..22: mol_type = other RNA
ggagcaccgttaaggacaagtt

SEQ ID NO: 455 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = gm
  modified_base 7: mod_base = OTHER; note = 2'-fluoroguanosine
  modified_base 8: mod_base = OTHER; note = 2'-fluoroadenosine
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = um
  modified_base 13: mod_base = OTHER; note = 2'-O-methyladenosine
  modified_base 14: mod_base = um
  modified_base 15: mod_base = um
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
aaaagggacagtattctcatt

SEQ ID NO: 456 - RNA, 19 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-fluoroguanosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-O-methyladenosine
  modified_base 12: mod_base = gm
  modified_base 13: mod_base = um
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = um
  modified_base 19: mod_base = cm
  source 1..19: mol_type = other RNA
caaaagggacagtattctc

SEQ ID NO: 457 - RNA, 20 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  source 1..20: mol_type = other RNA
ccaaaagggacagtattctc

SEQ ID NO: 458 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = um
  source 1..21: mol_type = other RNA
ccaaaagggacagtattctct

SEQ ID NO: 459 - RNA, 21 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = gm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = cm
  modified_base 19: mod_base = OTHER; note = 2'-O-methyladenosine
  modified_base 20: mod_base = um
  modified_base 21: mod_base = um
  source 1..21: mol_type = other RNA
ggtactccttgttgttgcatt

SEQ ID NO: 460 - RNA, 19 nt, synthetic construct
  modified_base 1: mod_base = gm
  modified_base 2: mod_base = gm
  modified_base 3: mod_base = gm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = OTHER; note = 2'-fluorocytidine
  modified_base 9: mod_base = OTHER; note = 2'-fluorocytidine
  modified_base 10: mod_base = OTHER; note = 2'-fluorouridine
  modified_base 11: mod_base = um
  modified_base 12: mod_base = gm
  modified_base 13: mod_base = um
  modified_base 14: mod_base = um
  modified_base 15: mod_base = gm
  modified_base 16: mod_base = um
  modified_base 17: mod_base = um
  modified_base 18: mod_base = gm
  modified_base 19: mod_base = cm
  source 1..19: mol_type = other RNA
gggtactccttgttgttgc

SEQ ID NO: 461 - RNA, 18 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = gm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = cm
  source 1..18: mol_type = other RNA
ggtactccttgttgttgc

SEQ ID NO: 462 - RNA, 19 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluorouridine
  modified_base 10: mod_base = um
  modified_base 11: mod_base = gm
  modified_base 12: mod_base = um
  modified_base 13: mod_base = um
  modified_base 14: mod_base = gm
  modified_base 15: mod_base = um
  modified_base 16: mod_base = um
  modified_base 17: mod_base = gm
  modified_base 18: mod_base = cm
  modified_base 19: mod_base = um
  source 1..19: mol_type = other RNA
ggtactccttgttgttgct

SEQ ID NO: 463 - RNA, 21 nt, synthetic construct
  modified_base 1: mod_base = um
  modified_base 2: mod_base = gm
  modified_base 3: mod_base = gm
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = cm
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
tgggtgaccgatggcttcaga

SEQ ID NO: 464 - RNA, 21 nt, synthetic construct
  modified_base 1: mod_base = um
  modified_base 2: mod_base = gm
  modified_base 3: mod_base = gm
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = cm
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = gm
  modified_base 21: mod_base = um
  source 1..21: mol_type = other RNA
tgggtgaccgatggcttcagt

SEQ ID NO: 465 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
tgaccgatggcttcagttcca

SEQ ID NO: 466 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
ggaccgatggcttcagttcca

SEQ ID NO: 467 - RNA, 21 nt, synthetic construct
  modified_base 1: mod_base = gm
  modified_base 2: mod_base = gm
  modified_base 3: mod_base = cm
  modified_base 4: mod_base = um
  modified_base 5: mod_base = um
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = cm
  modified_base 14: mod_base = um
  modified_base 15: mod_base = gm
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
ggcttcagttccctgaaagaa

SEQ ID NO: 468 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = cm
  modified_base 15: mod_base = cm
  modified_base 16: mod_base = gm
  modified_base 17: mod_base = um
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gactactggagcaccgttaaa

SEQ ID NO: 469 - RNA, 21 nt, synthetic construct
  modified_base 1: mod_base = cm
  modified_base 2: mod_base = um
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = cm
  modified_base 13: mod_base = cm
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine
  source 1..21: mol_type = other RNA
ctactggagcaccgttaagga

SEQ ID NO: 470 - RNA, 21 nt, synthetic construct
  modified_base 1: mod_base = um
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
tactggagcaccgttaaggaa

SEQ ID NO: 471 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gactggagcaccgttaaggaa

SEQ ID NO: 472 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
gagcaccgttaaggacaagta

SEQ ID NO: 473 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = um
  modified_base 21: mod_base = um
  source 1..21: mol_type = other RNA
gagcaccgttaaggacaagtt

SEQ ID NO: 474 - RNA, 21 nt, synthetic construct
  modified_base 1: mod_base = OTHER; note = 2'-O-methyladenosine
  modified_base 2: mod_base = gm
  modified_base 3: mod_base = um
  modified_base 4: mod_base = gm
  modified_base 5: mod_base = gm
  modified_base 6: mod_base = cm
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = gm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = cm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
agtggctgcctgagacctcaa

SEQ ID NO: 475 - RNA, 21 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ggctgcctgagacctcaataa

SEQ ID NO: 476 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = cm
  modified_base 6: mod_base = cm
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
gctgcctgagacctcaataca

SEQ ID NO: 477 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
aagggacagtattctcagtga

SEQ ID NO: 478 - RNA, 21 nt, synthetic construct
  modified_base 1: mod_base = OTHER; note = 2'-O-methyladenosine
  modified_base 2: mod_base = cm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
acgggacagtattctcagtga

SEQ ID NO: 479 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = gm
  modified_base 6: mod_base = um
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = gm
  modified_base 13: mod_base = cm
  modified_base 14: mod_base = um
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ccctgtaggttgcttaaaaga

SEQ ID NO: 480 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggaaaagggacagtattctca

SEQ ID NO: 481 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggaaaagggacagtattctca

SEQ ID NO: 482 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
gagggacagtattctcagtga

SEQ ID NO: 483 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagggacagtattctca

SEQ ID NO: 484 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagggacagtattctca

SEQ ID NO: 485 - RNA, 21 nt, synthetic construct
  modified_base 1: mod_base = um
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine-3'phosphate
  modified_base 10: mod_base = OTHER; note = 2'-fluoroguanosine-3'phosphate
  modified_base 11: mod_base = OTHER; note = 2'-fluorocytidine-3'phosphate
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = OTHER; note = 2'-O-methylinosine
  modified_base 17: mod_base = um
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
tgaccgatggcttcanttcca

SEQ ID NO: 486 - RNA, 21 nt, synthetic construct
  modified_base 1: mod_base = um
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
tgaccgatggcttcagttcca

SEQ ID NO: 487 - RNA, 21 nt, synthetic construct
  modified_base 1: mod_base = um
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = OTHER; note = 2'-O-methyladenosine
  modified_base 16: mod_base = OTHER; note = 2'-O-methylinosine
  modified_base 17: mod_base = um
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
tgaccgatggcttcanttcca

SEQ ID NO: 488 - RNA, 21 nt, synthetic construct
  modified_base 1: mod_base = gm
  modified_base 1^2: mod_base = OTHER; note = phosphorothioate linkage
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
gagggacagtattctcagtga

SEQ ID NO: 489 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = cm
  modified_base 4: mod_base = um
  modified_base 5: mod_base = gm
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ggctgcctgagacctcaataa

SEQ ID NO: 490 - RNA, 21 nt, synthetic construct
  source 1..21: mol_type = other RNA
  modified_base 1: mod_base = gm
  modified_base 2: mod_base = gm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  modified_base 3: mod_base = OTHER; note = 2'-O-methyl-2-aminoadenosine
ggnaaagggacagtattctca

SEQ ID NO: 491 - RNA, 21 nt, synthetic construct
  source 1..21: mol_type = other RNA
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  modified_base 1: mod_base = OTHER; note = 2'-O-methyl-2-aminoadenosine
ngaaaagggacagtattctca

SEQ ID NO: 492 - RNA, 21 nt, synthetic construct
  source 1..21: mol_type = other RNA
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  modified_base 1: mod_base = OTHER; note = 2'-O-methyl-2-aminoadenosine
nnaaaagggacagtattctca

SEQ ID NO: 493 - RNA, 21 nt, synthetic construct
  modified_base 1: mod_base = cm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
cccaataaagctggacaagaa

SEQ ID NO: 494 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 495 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttccctgaaagacta

SEQ ID NO: 496 - RNA, 21 nt, synthetic construct
  modified_base 1: mod_base = gm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gttcagttccctgaaagacta

SEQ ID NO: 497 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaagggacagtattct

SEQ ID NO: 498 - RNA, 21 nt, synthetic construct
  modified_base 1: mod_base = gm
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluoroadenosine
  modified_base 10: mod_base = um
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = um
  modified_base 21: mod_base = um
  source 1..21: mol_type = other RNA
gggacagtattctcagtgatt

SEQ ID NO: 499 - RNA, 21 nt, synthetic construct
  source 1..21: mol_type = other RNA
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  modified_base 1: mod_base = OTHER; note = 2'-O-methyl-2-aminoadenosine
nagggacagtattctcagtga

SEQ ID NO: 500 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methylinosine
  modified_base 19: mod_base = um
  modified_base 20: mod_base = gm
  modified_base 21: mod_base = OTHER; note = 2'-O-methyladenosine
  source 1..21: mol_type = other RNA
gagggacagtattctcantga

SEQ ID NO: 501 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
gagggacagtattctcagtna

SEQ ID NO: 502 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = cm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
acgggacagtattctcagtga

SEQ ID NO: 503 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluoroadenosine
  modified_base 10: mod_base = um
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = um
  modified_base 21: mod_base = um
  source 1..21: mol_type = other RNA
gggacagtattctcagtgatt

SEQ ID NO: 504 - RNA, 21 nt, synthetic construct
  modified_base 1: mod_base = cm
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluoroadenosine
  modified_base 10: mod_base = um
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = gm
  modified_base 19: mod_base = OTHER; note = 2'-O-methyladenosine
  modified_base 20: mod_base = um
  modified_base 21: mod_base = um
  source 1..21: mol_type = other RNA
cggacagtattctcagtgatt

SEQ ID NO: 505 - RNA, 21 nt, synthetic construct
  modified_base 1: mod_base = gm
  modified_base 1^2: mod_base = OTHER; note = phosphorothioate linkage
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = guanosine
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagggacagtattctca

SEQ ID NO: 506 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methylinosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagngacagtattctca

SEQ ID NO: 507 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methylinosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaanggacagtattctca

SEQ ID NO: 508 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
agggtactccttgttgttgca

SEQ ID NO: 509 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttctctgaaagacta

SEQ ID NO: 510 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagtttcctgaaagacta

SEQ ID NO: 511 - RNA, 21 nt, synthetic construct
  modified_base 1: mod_base = cm
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cgtcagttccctgaaagacta

SEQ ID NO: 512 - RNA, 21 nt, synthetic construct
  modified_base 1: mod_base = cm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cctcagttccctgaaagacta

SEQ ID NO: 513 - RNA, 21 nt, synthetic construct
  modified_base 1: mod_base = cm
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cgtcagttctctgaaagacta

SEQ ID NO: 514 - RNA, 21 nt, synthetic construct
  modified_base 1: mod_base = gm
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
ggtcagttccctgaaagacta

SEQ ID NO: 515 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gctcagttccctgaaagacta

SEQ ID NO: 516 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaagggacagtattct

SEQ ID NO: 517 - RNA, 21 nt, synthetic construct
  modified_base 1: mod_base = cm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
ccttaaaagggacagtattct

SEQ ID NO: 518 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methylinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaaggnacagtattct

SEQ ID NO: 519 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-O-methylinosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaagngacagtattct

SEQ ID NO: 520 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-O-methylinosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaanggacagtattct

SEQ ID NO: 521 - RNA, 21 nt, synthetic construct
  modified_base 1: mod_base = cm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
ccctaaaagggacagtattct

SEQ ID NO: 522 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = OTHER; note = 2'-O-methylinosine
  modified_base 20: mod_base = cm
  modified_base 21: mod_base = OTHER; note = 2'-O-methyladenosine
  source 1..21: mol_type = other RNA
agggtactccttgttgttnca

SEQ ID NO: 523 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = OTHER; note = guanosine
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
agggtactccttgttgttgca

SEQ ID NO: 524 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = OTHER; note = 2'-O-methylinosine
  modified_base 20: mod_base = um
  modified_base 21: mod_base = OTHER; note = 2'-O-methyladenosine
  source 1..21: mol_type = other RNA
cttcagttccctgaaaganta

SEQ ID NO: 525 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = OTHER; note = guanosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttccctgaaagacta

SEQ ID NO: 526 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = OTHER; note = 2'-O-methylinosine
  modified_base 21: mod_base = um
  source 1..21: mol_type = other RNA
gcttaaaagggacagtattnt

SEQ ID NO: 527 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = OTHER; note = cytidine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaagggacagtattct

SEQ ID NO: 528 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
ggcaaagggacagtattctna

SEQ ID NO: 529 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = guanosine
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagggacagtattctca

SEQ ID NO: 530 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = OTHER; note = uridine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
gagggacagtattctcagtna

SEQ ID NO: 531 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylinosine
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaanaa

SEQ ID NO: 532 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = OTHER; note = guanosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 533 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroinosine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
agggtactcattgttgttgca

SEQ ID NO: 534 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroinosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = um
  modified_base 15: mod_base = um
  modified_base 16: mod_base = gm
  modified_base 17: mod_base = um
  modified_base 18: mod_base = um
  modified_base 19: mod_base = gm
  modified_base 20: mod_base = cm
  modified_base 21: mod_base = OTHER; note = 2'-O-methyladenosine
  source 1..21: mol_type = other RNA
agggtactacttgttgttgca

SEQ ID NO: 535 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroinosine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttccatgaaagacta

SEQ ID NO: 536 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroinosine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttcactgaaagacta

SEQ ID NO: 537 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluoroinosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cttcagttacctgaaagacta

SEQ ID NO: 538 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaaggaacagtattct

SEQ ID NO: 539 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroinosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaagagacagtattct

SEQ ID NO: 540 - RNA, 21 nt, synthetic construct
  modified_base 1: mod_base = gm
  modified_base 2: mod_base = cm
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroinosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcttaaaaaggacagtattct

SEQ ID NO: 541 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroinosine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaagggaaagtattctca

SEQ ID NO: 542 - RNA, 21 nt, synthetic construct
  modified_base 1: mod_base = gm
  modified_base 2: mod_base = gm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroinosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = cm
  modified_base 21: mod_base = OTHER; note = 2'-O-methyladenosine
  source 1..21: mol_type = other RNA
ggcaaaggaacagtattctca

SEQ ID NO: 543 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroinosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = i
  modified_base 21: mod_base = OTHER; note = 2'-O-methyladenosine
  source 1..21: mol_type = other RNA
gagggacaatattctcagtna

SEQ ID NO: 544 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroinosine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagatggacaagaa

SEQ ID NO: 545 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroinosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaaactggacaagaa

SEQ ID NO: 546 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-O-methylinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaaggnacagtattct

SEQ ID NO: 547 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaaggaacagtattct

SEQ ID NO: 548 - RNA, 21 nt, synthetic construct
  modified_base 1: mod_base = OTHER; note = 2'-O-methyladenosine
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
acctaaaagggacagtattct

SEQ ID NO: 549 - RNA, 21 nt, synthetic construct
  modified_base 1: mod_base = gm
  modified_base 2: mod_base = cm
  modified_base 3: mod_base = gm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcgtaaaagggacagtattct

SEQ ID NO: 550 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gtctaaaagggacagtattct

SEQ ID NO: 551 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = OTHER; note = uridine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
gagggacagtattctcagtga

SEQ ID NO: 552 - RNA, 21 nt, synthetic construct
  modified_base 1: mod_base = gm
  modified_base 2: mod_base = gm
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluoroadenosine
  modified_base 10: mod_base = um
  modified_base 11: mod_base = um
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methylinosine
  modified_base 19: mod_base = OTHER; note = 2'-O-methyladenosine
  modified_base 20: mod_base = um
  modified_base 21: mod_base = um
  source 1..21: mol_type = other RNA
gggacagtattctcagtnatt

SEQ ID NO: 553 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = OTHER; note = 2'-deoxyguanosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 554 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-fluorocytidine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaagggacagtattct

SEQ ID NO: 555 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = gm
  modified_base 11: mod_base = OTHER; note = 2'-fluoroinosine
  modified_base 12: mod_base = OTHER; note = 2'-O-methyladenosine
  modified_base 13: mod_base = OTHER; note = 2'-fluorocytidine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaaggaacagtattct

SEQ ID NO: 556 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = um
  modified_base 11: mod_base = OTHER; note = 2'-fluoroadenosine
  modified_base 12: mod_base = um
  modified_base 13: mod_base = OTHER; note = 2'-fluorouridine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
gagggacagtattctcagtga

SEQ ID NO: 557 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = um
  modified_base 11: mod_base = OTHER; note = 2'-fluoroadenosine
  modified_base 12: mod_base = um
  modified_base 13: mod_base = OTHER; note = 2'-fluorouridine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
gagggacagtattctcagtna

SEQ ID NO: 558 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 559 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = gm
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 560 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-fluorouridine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctggacaagaa

SEQ ID NO: 561 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methoxyethyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaatatagctggacaagaa

SEQ ID NO: 562 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methoxyethyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcctataaagctggacaagaa

SEQ ID NO: 563 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroinosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaaactggacaagaa

SEQ ID NO: 564 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-fluorouridine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroinosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaaactggacaagaa

SEQ ID NO: 565 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-O-methylinosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaanctggacaagaa

SEQ ID NO: 566 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = OTHER; note = 2'-O-methylinosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctngacaagaa

SEQ ID NO: 567 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methylinosine
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gccaataaagctgnacaagaa

SEQ ID NO: 568 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaagggacagtattct

SEQ ID NO: 569 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroguanosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaagggacagtattct

SEQ ID NO: 570 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaaggaacagtattct

SEQ ID NO: 571 - RNA, 21 nt, synthetic construct
  modified_base 1: mod_base = gm
  modified_base 2: mod_base = cm
  modified_base 3: mod_base = OTHER; note = 2'-fluorocytidine
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluoroguanosine
  modified_base 10: mod_base = gm
  modified_base 11: mod_base = OTHER; note = 2'-fluoroinosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = um
  source 1..21: mol_type = other RNA
gcctaaaaggaacagtattct

SEQ ID NO: 572 - RNA, 21 nt, synthetic construct
  modified_base 1: mod_base = OTHER; note = 2'-O-methyladenosine
  modified_base 2: mod_base = cm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
acgggacagtattctcagtna

SEQ ID NO: 573 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
cagggacagtattctcagtga

SEQ ID NO: 574 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
cagggacagtattctcagtna

SEQ ID NO: 575 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = gm
  modified_base 21: mod_base = OTHER; note = 2'-O-methyladenosine
  source 1..21: mol_type = other RNA
aggggacagtattctcagtga

SEQ ID NO: 576 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = gm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
aggggacagtattctcagtna

SEQ ID NO: 577 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = um
  modified_base 15: mod_base = gm
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
agaccgccaaggatgcacttt

SEQ ID NO: 578 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = gm
  modified_base 7: mod_base = OTHER; note = 2'-fluorocytidine
  modified_base 8: mod_base = OTHER; note = 2'-fluorocytidine
  modified_base 9: mod_base = OTHER; note = 2'-fluoroadenosine
  modified_base 10: mod_base = OTHER; note = 2'-O-methyladenosine
  modified_base 11: mod_base = gm
  modified_base 12: mod_base = gm
  modified_base 13: mod_base = OTHER; note = 2'-O-methyladenosine
  modified_base 14: mod_base = um
  modified_base 15: mod_base = OTHER; note = 2'-O-methylinosine
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
agaccgccaaggatncacttt

SEQ ID NO: 579 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = gm
  modified_base 5: mod_base = um
  modified_base 6: mod_base = um
  modified_base 7: mod_base = cm
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = OTHER; note = 2'-O-methyladenosine
  modified_base 17: mod_base = cm
  modified_base 18: mod_base = um
  modified_base 19: mod_base = OTHER; note = 2'-O-methyladenosine
  modified_base 20: mod_base = cm
  modified_base 21: mod_base = um
  source 1..21: mol_type = other RNA
tcagttccctgaaagactact

SEQ ID NO: 580 - RNA, 21 nt, synthetic construct
  modified_base 1: mod_base = um
  modified_base 2: mod_base = cm
  modified_base 3: mod_base = OTHER; note = 2'-O-methyladenosine
  modified_base 4: mod_base = gm
  modified_base 5: mod_base = um
  modified_base 6: mod_base = um
  modified_base 7: mod_base = cm
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = gm
  modified_base 16: mod_base = OTHER; note = 2'-O-methyladenosine
  modified_base 17: mod_base = cm
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
tcagttccctgaaagactaca

SEQ ID NO: 581 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = OTHER; note = 2'-O-methyladenosine
  modified_base 5: mod_base = cm
  modified_base 6: mod_base = um
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methylinosine
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
actactggagcaccnttaaga

SEQ ID NO: 582 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine
  source 1..21: mol_type = other RNA
cctgtaggttgcttaaaagga

SEQ ID NO: 583 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine
  source 1..21: mol_type = other RNA
gctgtaggttgcttaaaagga

SEQ ID NO: 584 - RNA, 21 nt, synthetic construct
  modified_base 1: mod_base = gm
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
ggtcagttctctgaaagacta

SEQ ID NO: 585 - RNA, 21 nt, synthetic construct
  source 1..21: mol_type = other RNA
taacaacaaggagtacccgtt

SEQ ID NO: 586 - RNA, 21 nt, synthetic construct
  source 1..21: mol_type = other RNA
taacaacaaggagtacccggt

SEQ ID NO: 587 - RNA, 21 nt, synthetic construct
  source 1..21: mol_type = other RNA
taacaacaaggagtacccggg

SEQ ID NO: 588 - RNA, 21 nt, synthetic construct
  source 1..21: mol_type = other RNA
tgcaacaacaaggagtacctt

SEQ ID NO: 589 - RNA, 21 nt, synthetic construct
  source 1..21: mol_type = other RNA
tgcaacaacaaggagtaccct

SEQ ID NO: 590 - RNA, 21 nt, synthetic construct
  source 1..21: mol_type = other RNA
tgcaacaacaaggagtacccg

SEQ ID NO: 591 - RNA, 21 nt, synthetic construct
  source 1..21: mol_type = other RNA
tagccatcggtcacccagctt

SEQ ID NO: 592 - RNA, 21 nt, synthetic construct
  source 1..21: mol_type = other RNA
tagccatcggtcacccagcct

SEQ ID NO: 593 - RNA, 21 nt, synthetic construct
  source 1..21: mol_type = other RNA
tagccatcggtcacccagccc

SEQ ID NO: 594 - RNA, 21 nt, synthetic construct
  source 1..21: mol_type = other RNA
tgaactgaagccatcggtctt

SEQ ID NO: 595 - RNA, 21 nt, synthetic construct
  source 1..21: mol_type = other RNA
tgaactgaagccatcggtcat

SEQ ID NO: 596 - RNA, 21 nt, synthetic construct
  source 1..21: mol_type = other RNA
tgaactgaagccatcggtcac

SEQ ID NO: 597 - RNA, 21 nt, synthetic construct
  source 1..21: mol_type = other RNA
tctttcagggaactgaagctt

SEQ ID NO: 598 - RNA, 21 nt, synthetic construct
  source 1..21: mol_type = other RNA
tctttcagggaactgaagcct

SEQ ID NO: 599 - RNA, 21 nt, synthetic construct
  source 1..21: mol_type = other RNA
tctttcagggaactgaagcca

SEQ ID NO: 600 - RNA, 21 nt, synthetic construct
  source 1..21: mol_type = other RNA
taacggtgctccagtagtctt

SEQ ID NO: 601 - RNA, 21 nt, synthetic construct
  source 1..21: mol_type = other RNA
ttaacggtgctccagtagttt

SEQ ID NO: 602 - RNA, 21 nt, synthetic construct
  source 1..21: mol_type = other RNA
ttaacggtgctccagtagtct

SEQ ID NO: 603 - RNA, 21 nt, synthetic construct
  source 1..21: mol_type = other RNA
tacttgtccttaacggtgctt

SEQ ID NO: 604 - RNA, 21 nt, synthetic construct
  source 1..21: mol_type = other RNA
tacttgtccttaacggtgctc

SEQ ID NO: 605 - RNA, 21 nt, synthetic construct
  source 1..21: mol_type = other RNA
tgaacttgtccttaacggttt

SEQ ID NO: 606 - RNA, 21 nt, synthetic construct
  source 1..21: mol_type = other RNA
tgaacttgtccttaacggtgt

SEQ ID NO: 607 - RNA, 21 nt, synthetic construct
  source 1..21: mol_type = other RNA
tgaacttgtccttaacggtgc

SEQ ID NO: 608 - RNA, 21 nt, synthetic construct
  source 1..21: mol_type = other RNA
tagaacttgtccttaacggtt

SEQ ID NO: 609 - RNA, 21 nt, synthetic construct
  source 1..21: mol_type = other RNA
tagaacttgtccttaacggtg

SEQ ID NO: 610 - RNA, 21 nt, synthetic construct
  source 1..21: mol_type = other RNA
tggacttggggtattgaggtt

SEQ ID NO: 611 - RNA, 21 nt, synthetic construct
  source 1..21: mol_type = other RNA
tggacttggggtattgaggtc

SEQ ID NO: 612 - RNA, 21 nt, synthetic construct
  source 1..21: mol_type = other RNA
tgagaatactgtccctttttt

SEQ ID NO: 613 - RNA, 21 nt, synthetic construct
  source 1..21: mol_type = other RNA
tgagaatactgtcccttttat

SEQ ID NO: 614 - RNA, 21 nt, synthetic construct
  source 1..21: mol_type = other RNA
tgagaatactgtcccttttaa

SEQ ID NO: 615 - RNA, 21 nt, synthetic construct
  source 1..21: mol_type = other RNA
tactgagaatactgtcccttt

SEQ ID NO: 616 - RNA, 21 nt, synthetic construct
  source 1..21: mol_type = other RNA
cgggtactccttgttgttatt

SEQ ID NO: 617 - RNA, 20 nt, synthetic construct
  source 1..20: mol_type = other RNA
ccgggtactccttgttgtta

SEQ ID NO: 618 - RNA, 21 nt, synthetic construct
  source 1..21: mol_type = other RNA
cccgggtactccttgttgtta

SEQ ID NO: 619 - RNA, 21 nt, synthetic construct
  source 1..21: mol_type = other RNA
ggtactccttgttgttgcatt

SEQ ID NO: 620 - RNA, 20 nt, synthetic construct
  source 1..20: mol_type = other RNA
gggtactccttgttgttgca

SEQ ID NO: 621 - RNA, 21 nt, synthetic construct
  source 1..21: mol_type = other RNA
cgggtactccttgttgttgca

SEQ ID NO: 622 - RNA, 21 nt, synthetic construct
  source 1..21: mol_type = other RNA
gctgggtgaccgatggctatt

SEQ ID NO: 623 - RNA, 20 nt, synthetic construct
  source 1..20: mol_type = other RNA
ggctgggtgaccgatggcta

SEQ ID NO: 624 - RNA, 21 nt, synthetic construct
  source 1..21: mol_type = other RNA
gggctgggtgaccgatggcta

SEQ ID NO: 625 - RNA, 21 nt, synthetic construct
  source 1..21: mol_type = other RNA
gaccgatggcttcagttcatt

SEQ ID NO: 626 - RNA, 20 nt, synthetic construct
  source 1..20: mol_type = other RNA
tgaccgatggcttcagttca

SEQ ID NO: 627 - RNA, 21 nt, synthetic construct
  source 1..21: mol_type = other RNA
gtgaccgatggcttcagttca

SEQ ID NO: 628 - RNA, 21 nt, synthetic construct
  source 1..21: mol_type = other RNA
gcttcagttccctgaaagatt

SEQ ID NO: 629 - RNA, 20 nt, synthetic construct
  source 1..20: mol_type = other RNA
ggcttcagttccctgaaaga

SEQ ID NO: 630 - RNA, 21 nt, synthetic construct
  source 1..21: mol_type = other RNA
tggcttcagttccctgaaaga

SEQ ID NO: 631 - RNA, 21 nt, synthetic construct
  source 1..21: mol_type = other RNA
gactactggagcaccgttatt

SEQ ID NO: 632 - RNA, 20 nt, synthetic construct
  source 1..20: mol_type = other RNA
agactactggagcaccgtta

SEQ ID NO: 633 - RNA, 21 nt, synthetic construct
  source 1..21: mol_type = other RNA
aagactactggagcaccgtta

SEQ ID NO: 634 - RNA, 21 nt, synthetic construct
  source 1..21: mol_type = other RNA
actactggagcaccgttaatt

SEQ ID NO: 635 - RNA, 20 nt, synthetic construct
  source 1..20: mol_type = other RNA
gactactggagcaccgttaa

SEQ ID NO: 636 - RNA, 21 nt, synthetic construct
  source 1..21: mol_type = other RNA
agactactggagcaccgttaa

SEQ ID NO: 637 - RNA, 21 nt, synthetic construct
  source 1..21: mol_type = other RNA
gcaccgttaaggacaagtatt

SEQ ID NO: 638 - RNA, 20 nt, synthetic construct
  source 1..20: mol_type = other RNA
agcaccgttaaggacaagta

SEQ ID NO: 639 - RNA, 21 nt, synthetic construct
  source 1..21: mol_type = other RNA
gagcaccgttaaggacaagta

SEQ ID NO: 640 - RNA, 21 nt, synthetic construct
  source 1..21: mol_type = other RNA
accgttaaggacaagttcatt

SEQ ID NO: 641 - RNA, 20 nt, synthetic construct
  source 1..20: mol_type = other RNA
caccgttaaggacaagttca

SEQ ID NO: 642 - RNA, 21 nt, synthetic construct
  source 1..21: mol_type = other RNA
gcaccgttaaggacaagttca

SEQ ID NO: 643 - RNA, 21 nt, synthetic construct
  source 1..21: mol_type = other RNA
ccgttaaggacaagttctatt

SEQ ID NO: 644 - RNA, 20 nt, synthetic construct
  source 1..20: mol_type = other RNA
accgttaaggacaagttcta

SEQ ID NO: 645 - RNA, 21 nt, synthetic construct
  source 1..21: mol_type = other RNA
caccgttaaggacaagttcta

SEQ ID NO: 646 - RNA, 21 nt, synthetic construct
  source 1..21: mol_type = other RNA
cctcaataccccaagtccatt

SEQ ID NO: 647 - RNA, 20 nt, synthetic construct
  source 1..20: mol_type = other RNA
acctcaataccccaagtcca

SEQ ID NO: 648 - RNA, 21 nt, synthetic construct
  source 1..21: mol_type = other RNA
gacctcaataccccaagtcca

SEQ ID NO: 649 - RNA, 21 nt, synthetic construct
  source 1..21: mol_type = other RNA
aaaagggacagtattctcatt

SEQ ID NO: 650 - RNA, 20 nt, synthetic construct
  source 1..20: mol_type = other RNA
taaaagggacagtattctca

SEQ ID NO: 651 - RNA, 21 nt, synthetic construct
  source 1..21: mol_type = other RNA
ttaaaagggacagtattctca

SEQ ID NO: 652 - RNA, 21 nt, synthetic construct
  source 1..21: mol_type = other RNA
agggacagtattctcagtatt

SEQ ID NO: 653 - RNA, 20 nt, synthetic construct
  source 1..20: mol_type = other RNA
aagggacagtattctcagta

SEQ ID NO: 654 - RNA, 21 nt, synthetic construct
  source 1..21: mol_type = other RNA
aaagggacagtattctcagta

SEQ ID NO: 655 - RNA, 21 nt, synthetic construct
  source 1..21: mol_type = other RNA
aacttgtccttaacggtgctt

SEQ ID NO: 656 - RNA, 21 nt, synthetic construct
  source 1..21: mol_type = other RNA
tgagaatactgtcccttttgg

SEQ ID NO: 657 - RNA, 22 nt, synthetic construct
  source 1..22: mol_type = other RNA
tgagaatactgtcccttttgcg

SEQ ID NO: 658 - RNA, 21 nt, synthetic construct
  source 1..21: mol_type = other RNA
taacggtgctccagtagtcgt

SEQ ID NO: 659 - RNA, 21 nt, synthetic construct
  source 1..21: mol_type = other RNA
tactgagaatactgtccctgt

SEQ ID NO: 660 - RNA, 21 nt, synthetic construct
  source 1..21: mol_type = other RNA
ttaacggtgctccagtaggct

SEQ ID NO: 661 - RNA, 21 nt, synthetic construct
  source 1..21: mol_type = other RNA
aagccatcggtcacccagctt

SEQ ID NO: 662 - RNA, 21 nt, synthetic construct
  source 1..21: mol_type = other RNA
agaacttgtccttaacggttt

SEQ ID NO: 663 - RNA, 22 nt, synthetic construct
  source 1..22: mol_type = other RNA
tgcactgagaatactgtccctt

SEQ ID NO: 664 - RNA, 22 nt, synthetic construct
  source 1..22: mol_type = other RNA
agcactgagaatactgtccctt

SEQ ID NO: 665 - RNA, 22 nt, synthetic construct
  source 1..22: mol_type = other RNA
ctacttgtccttaacggtgctt

SEQ ID NO: 666 - RNA, 21 nt, synthetic construct
  source 1..21: mol_type = other RNA
aacttgtccttaacggtgctc

SEQ ID NO: 667 - RNA, 19 nt, synthetic construct
  source 1..19: mol_type = other RNA
tacttgtccttaacggtgc

SEQ ID NO: 668 - RNA, 22 nt, synthetic construct
  source 1..22: mol_type = other RNA
tacttgtccttaacggtgctcc

SEQ ID NO: 669 - RNA, 23 nt, synthetic construct
  source 1..23: mol_type = other RNA
tacttgtccttaacggtgctctt

SEQ ID NO: 670 - RNA, 23 nt, synthetic construct
  source 1..23: mol_type = other RNA
tacttgtccttaacggtgctcca

SEQ ID NO: 671 - RNA, 19 nt, synthetic construct
  source 1..19: mol_type = other RNA
aacttgtccttaacggtgc

SEQ ID NO: 672 - RNA, 22 nt, synthetic construct
  source 1..22: mol_type = other RNA
aacttgtccttaacggtgctcc

SEQ ID NO: 673 - RNA, 21 nt, synthetic construct
  source 1..21: mol_type = other RNA
tgagaatactgtcccttttgt

SEQ ID NO: 674 - RNA, 21 nt, synthetic construct
  source 1..21: mol_type = other RNA
agagaatactgtcccttttgg

SEQ ID NO: 675 - RNA, 19 nt, synthetic construct
  source 1..19: mol_type = other RNA
tgcaacaacaaggagtacc

SEQ ID NO: 676 - RNA, 21 nt, synthetic construct
  source 1..21: mol_type = other RNA
agcaacaacaaggagtacctt

SEQ ID NO: 677 - RNA, 21 nt, synthetic construct
  source 1..21: mol_type = other RNA
tctgaagccatcggtcaccca

SEQ ID NO: 678 - RNA, 21 nt, synthetic construct
  source 1..21: mol_type = other RNA
actgaagccatcggtcaccca

SEQ ID NO: 679 - RNA, 21 nt, synthetic construct
  source 1..21: mol_type = other RNA
tggaactgaagccatcggtca

SEQ ID NO: 680 - RNA, 21 nt, synthetic construct
  source 1..21: mol_type = other RNA
tggaactgaagccatcggtcc

SEQ ID NO: 681 - RNA, 21 nt, synthetic construct
  source 1..21: mol_type = other RNA
ttctttcagggaactgaagcc

SEQ ID NO: 682 - RNA, 21 nt, synthetic construct
  source 1..21: mol_type = other RNA
tttaacggtgctccagtagtc

SEQ ID NO: 683 - RNA, 21 nt, synthetic construct
  source 1..21: mol_type = other RNA
tccttaacggtgctccagtag

SEQ ID NO: 684 - RNA, 21 nt, synthetic construct
  source 1..21: mol_type = other RNA
ttccttaacggtgctccagta

SEQ ID NO: 685 - RNA, 21 nt, synthetic construct
  source 1..21: mol_type = other RNA
ttccttaacggtgctccagtc

SEQ ID NO: 686 - RNA, 21 nt, synthetic construct
  source 1..21: mol_type = other RNA
ttgaggtctcaggcagccact

SEQ ID NO: 687 - RNA, 21 nt, synthetic construct
  source 1..21: mol_type = other RNA
ttattgaggtctcaggcagcc

SEQ ID NO: 688 - RNA, 21 nt, synthetic construct
  source 1..21: mol_type = other RNA
tgtattgaggtctcaggcagc

SEQ ID NO: 689 - RNA, 21 nt, synthetic construct
  source 1..21: mol_type = other RNA
tcactgagaatactgtccctt

SEQ ID NO: 690 - RNA, 21 nt, synthetic construct
  source 1..21: mol_type = other RNA
tcttttaagcaacctacaggg

SEQ ID NO: 691 - RNA, 21 nt, synthetic construct
  source 1..21: mol_type = other RNA
tgagaatactgtcccttttcc

SEQ ID NO: 692 - RNA, 21 nt, synthetic construct
  source 1..21: mol_type = other RNA
tgagaatactgtcccttttct

SEQ ID NO: 693 - RNA, 21 nt, synthetic construct
  source 1..21: mol_type = other RNA
ttcttgtccagctttattggg

SEQ ID NO: 694 - RNA, 21 nt, synthetic construct
  source 1..21: mol_type = other RNA
tagtctttcagggaactgaag

SEQ ID NO: 695 - RNA, 21 nt, synthetic construct
  source 1..21: mol_type = other RNA
tagtctttcagggaactgaac

SEQ ID NO: 696 - RNA, 21 nt, synthetic construct
  source 1..21: mol_type = other RNA
tcactgagaatactgtccgtt

SEQ ID NO: 697 - RNA, 21 nt, synthetic construct
  source 1..21: mol_type = other RNA
tagtctttcagggaactgacg

SEQ ID NO: 698 - RNA, 21 nt, synthetic construct
  source 1..21: mol_type = other RNA
tagtctttcagggaactgagg

SEQ ID NO: 699 - RNA, 21 nt, synthetic construct
  source 1..21: mol_type = other RNA
tagtctttcagggaactgacc

SEQ ID NO: 700 - RNA, 21 nt, synthetic construct
  source 1..21: mol_type = other RNA
tagtctttcagggaactgagc

SEQ ID NO: 701 - RNA, 21 nt, synthetic construct
  source 1..21: mol_type = other RNA
agaatactgtcccttttaggc

SEQ ID NO: 702 - RNA, 21 nt, synthetic construct
  source 1..21: mol_type = other RNA
agaatactgtcccttttaagg

SEQ ID NO: 703 - RNA, 21 nt, synthetic construct
  source 1..21: mol_type = other RNA
agaatactgtcccttttaagc

SEQ ID NO: 704 - RNA, 21 nt, synthetic construct
  source 1..21: mol_type = other RNA
tgagaatactgtccctttgcc

SEQ ID NO: 705 - RNA, 21 nt, synthetic construct
  source 1..21: mol_type = other RNA
tcactgagaatactgtccctc

SEQ ID NO: 706 - RNA, 21 nt, synthetic construct
  source 1..21: mol_type = other RNA
ttcttgtccagctttattggc

SEQ ID NO: 707 - RNA, 21 nt, synthetic construct
  source 1..21: mol_type = other RNA
agaatactgtcccttttaggt

SEQ ID NO: 708 - RNA, 21 nt, synthetic construct
  source 1..21: mol_type = other RNA
agaatactgtcccttttacgc

SEQ ID NO: 709 - RNA, 21 nt, synthetic construct
  source 1..21: mol_type = other RNA
agaatactgtcccttttagac

SEQ ID NO: 710 - RNA, 21 nt, synthetic construct
  source 1..21: mol_type = other RNA
tcactgagaatactgtccctg

SEQ ID NO: 711 - RNA, 21 nt, synthetic construct
  source 1..21: mol_type = other RNA
tcactgagaatactgtcccct

SEQ ID NO: 712 - RNA, 21 nt, synthetic construct
  source 1..21: mol_type = other RNA
agtgcatccttggcggtcttt

SEQ ID NO: 713 - RNA, 21 nt, synthetic construct
  source 1..21: mol_type = other RNA
agtagtctttcagggaactga

SEQ ID NO: 714 - RNA, 21 nt, synthetic construct
  source 1..21: mol_type = other RNA
tgtagtctttcagggaactga

SEQ ID NO: 715 - RNA, 21 nt, synthetic construct
  source 1..21: mol_type = other RNA
tcttaacggtgctccagtagt

SEQ ID NO: 716 - RNA, 21 nt, synthetic construct
  source 1..21: mol_type = other RNA
tccttttaagcaacctacagg

SEQ ID NO: 717 - RNA, 21 nt, synthetic construct
  source 1..21: mol_type = other RNA
tccttttaagcaacctacagc

SEQ ID NO: 718 - RNA, 21 nt, synthetic construct
  source 1..21: mol_type = other RNA
gcaccgttaaggacaagtatt

SEQ ID NO: 719 - RNA, 21 nt, synthetic construct
  source 1..21: mol_type = other RNA
gagcaccgttaaggacaagta

SEQ ID NO: 720 - RNA, 19 nt, synthetic construct
  source 1..19: mol_type = other RNA
gcaccgttaaggacaagta

SEQ ID NO: 721 - RNA, 19 nt, synthetic construct
  source 1..19: mol_type = other RNA
gcaccgttaaggacaagtt

SEQ ID NO: 722 - RNA, 19 nt, synthetic construct
  source 1..19: mol_type = other RNA
cctcaataccccaagtcca

SEQ ID NO: 723 - RNA, 21 nt, synthetic construct
  source 1..21: mol_type = other RNA
gacctcaataccccaagtcca

SEQ ID NO: 724 - RNA, 19 nt, synthetic construct
  source 1..19: mol_type = other RNA
gcttcagttccctgaaaga

SEQ ID NO: 725 - RNA, 20 nt, synthetic construct
  source 1..20: mol_type = other RNA
ggcttcagttccctgaaaga

SEQ ID NO: 726 - RNA, 19 nt, synthetic construct
  source 1..19: mol_type = other RNA
gaccgatggcttcagttca

SEQ ID NO: 727 - RNA, 21 nt, synthetic construct
  source 1..21: mol_type = other RNA
gtgaccgatggcttcagttca

SEQ ID NO: 728 - RNA, 21 nt, synthetic construct
  source 1..21: mol_type = other RNA
ccaaaagggacagtattctca

SEQ ID NO: 729 - RNA, 22 nt, synthetic construct
  source 1..22: mol_type = other RNA
cgcaaaagggacagtattctca

SEQ ID NO: 730 - RNA, 19 nt, synthetic construct
  source 1..19: mol_type = other RNA
gactactggagcaccgtta

SEQ ID NO: 731 - RNA, 19 nt, synthetic construct
  source 1..19: mol_type = other RNA
gactactggagcactgtta

SEQ ID NO: 732 - RNA, 20 nt, synthetic construct
  source 1..20: mol_type = other RNA
cgactactggagcaccgtta

SEQ ID NO: 733 - RNA, 19 nt, synthetic construct
  source 1..19: mol_type = other RNA
gactactggagcatcgtta

SEQ ID NO: 734 - RNA, 19 nt, synthetic construct
  source 1..19: mol_type = other RNA
agggacagtattctcagta

SEQ ID NO: 735 - RNA, 20 nt, synthetic construct
  source 1..20: mol_type = other RNA
cagggacagtattctcagta

SEQ ID NO: 736 - RNA, 20 nt, synthetic construct
  source 1..20: mol_type = other RNA
gactactggagcaccgttaa

SEQ ID NO: 737 - RNA, 20 nt, synthetic construct
  source 1..20: mol_type = other RNA
gcctactggagcaccgttaa

SEQ ID NO: 738 - RNA, 20 nt, synthetic construct
  source 1..20: mol_type = other RNA
gcctactggagcactgttaa

SEQ ID NO: 739 - RNA, 19 nt, synthetic construct
  source 1..19: mol_type = other RNA
gctgggtgaccgatggcta

SEQ ID NO: 740 - RNA, 19 nt, synthetic construct
  source 1..19: mol_type = other RNA
gctgggtgaccgatggctt

SEQ ID NO: 741 - RNA, 19 nt, synthetic construct
  source 1..19: mol_type = other RNA
gctgggtgaccgatgacta

SEQ ID NO: 742 - RNA, 19 nt, synthetic construct
  source 1..19: mol_type = other RNA
ccgttaaggacaagttcta

SEQ ID NO: 743 - RNA, 21 nt, synthetic construct
  source 1..21: mol_type = other RNA
caccgttaaggacaagttcta

SEQ ID NO: 744 - RNA, 19 nt, synthetic construct
  source 1..19: mol_type = other RNA
accgttaaggacaagttca

SEQ ID NO: 745 - RNA, 19 nt, synthetic construct
  source 1..19: mol_type = other RNA
accgttaaggacaagttct

SEQ ID NO: 746 - RNA, 21 nt, synthetic construct
  source 1..21: mol_type = other RNA
gcaccgttaaggacaagttca

SEQ ID NO: 747 - RNA, 19 nt, synthetic construct
  source 1..19: mol_type = other RNA
ggtactccttgttgttgca

SEQ ID NO: 748 - RNA, 21 nt, synthetic construct
  source 1..21: mol_type = other RNA
cgggtactccttgttgttgca

SEQ ID NO: 749 - RNA, 19 nt, synthetic construct
  source 1..19: mol_type = other RNA
cgggtactccttgttgtta

SEQ ID NO: 750 - RNA, 20 nt, synthetic construct
  source 1..20: mol_type = other RNA
gggacagtattctcagtgca

SEQ ID NO: 751 - RNA, 20 nt, synthetic construct
  source 1..20: mol_type = other RNA
gggacagtattctcagtgct

SEQ ID NO: 752 - RNA, 21 nt, synthetic construct
  source 1..21: mol_type = other RNA
gcaccgttaaggacaagtttt

SEQ ID NO: 753 - RNA, 22 nt, synthetic construct
  source 1..22: mol_type = other RNA
ggagcaccgttaaggacaagta

SEQ ID NO: 754 - RNA, 21 nt, synthetic construct
  source 1..21: mol_type = other RNA
gagcaccgttaaggacaagtt

SEQ ID NO: 755 - RNA, 22 nt, synthetic construct
  source 1..22: mol_type = other RNA
ggagcaccgttaaggacaagtt

SEQ ID NO: 756 - RNA, 21 nt, synthetic construct
  source 1..21: mol_type = other RNA
aaaagggacagtattctcatt

SEQ ID NO: 757 - RNA, 20 nt, synthetic construct
  source 1..20: mol_type = other RNA
caaaagggacagtattctca

SEQ ID NO: 758 - RNA, 21 nt, synthetic construct
  source 1..21: mol_type = other RNA
ccaaaagggacagtattctct

SEQ ID NO: 759 - RNA, 21 nt, synthetic construct
  source 1..21: mol_type = other RNA
ggtactccttgttgttgcatt

SEQ ID NO: 760 - RNA, 20 nt, synthetic construct
  source 1..20: mol_type = other RNA
gggtactccttgttgttgca

SEQ ID NO: 761 - RNA, 19 nt, synthetic construct
  source 1..19: mol_type = other RNA
ggtactccttgttgttgct

SEQ ID NO: 762 - RNA, 21 nt, synthetic construct
  source 1..21: mol_type = other RNA
tgggtgaccgatggcttcaga

SEQ ID NO: 763 - RNA, 21 nt, synthetic construct
  source 1..21: mol_type = other RNA
tgggtgaccgatggcttcagt

SEQ ID NO: 764 - RNA, 21 nt, synthetic construct
  source 1..21: mol_type = other RNA
tgaccgatggcttcagttcca

SEQ ID NO: 765 - RNA, 21 nt, synthetic construct
  source 1..21: mol_type = other RNA
ggaccgatggcttcagttcca

SEQ ID NO: 766 - RNA, 21 nt, synthetic construct
  source 1..21: mol_type = other RNA
ggcttcagttccctgaaagaa

SEQ ID NO: 767 - RNA, 21 nt, synthetic construct
  source 1..21: mol_type = other RNA
gactactggagcaccgttaaa

SEQ ID NO: 768 - RNA, 21 nt, synthetic construct
  source 1..21: mol_type = other RNA
ctactggagcaccgttaagga

SEQ ID NO: 769 - RNA, 21 nt, synthetic construct
  source 1..21: mol_type = other RNA
tactggagcaccgttaaggaa

SEQ ID NO: 770 - RNA, 21 nt, synthetic construct
  source 1..21: mol_type = other RNA
gactggagcaccgttaaggaa

SEQ ID NO: 771 - RNA, 21 nt, synthetic construct
  source 1..21: mol_type = other RNA
agtggctgcctgagacctcaa

SEQ ID NO: 772 - RNA, 21 nt, synthetic construct
  source 1..21: mol_type = other RNA
ggctgcctgagacctcaataa

SEQ ID NO: 773 - RNA, 21 nt, synthetic construct
  source 1..21: mol_type = other RNA
gctgcctgagacctcaataca

SEQ ID NO: 774 - RNA, 21 nt, synthetic construct
  source 1..21: mol_type = other RNA
aagggacagtattctcagtga

SEQ ID NO: 775 - RNA, 21 nt, synthetic construct
  source 1..21: mol_type = other RNA
acgggacagtattctcagtga

SEQ ID NO: 776 - RNA, 21 nt, synthetic construct
  source 1..21: mol_type = other RNA
ccctgtaggttgcttaaaaga

SEQ ID NO: 777 - RNA, 21 nt, synthetic construct
  source 1..21: mol_type = other RNA
ggaaaagggacagtattctca

SEQ ID NO: 778 - RNA, 21 nt, synthetic construct
  modified_base 7: mod_base = i
  source 1..21: mol_type = other RNA
ggcaaanggacagtattctca

SEQ ID NO: 779 - RNA, 21 nt, synthetic construct
  modified_base 10: mod_base = i
  source 1..21: mol_type = other RNA
gcttaaaagngacagtattct

SEQ ID NO: 780 - RNA, 21 nt, synthetic construct
  modified_base 16: mod_base = i
  source 1..21: mol_type = other RNA
tgaccgatggcttcanttcca

SEQ ID NO: 781 - RNA, 21 nt, synthetic construct
  modified_base 3: mod_base = OTHER; note = 2-aminoadenine
  source 1..21: mol_type = other RNA
ggnaaagggacagtattctca

SEQ ID NO: 782 - RNA, 21 nt, synthetic construct
  modified_base 1: mod_base = OTHER; note = 2-aminoadenine
  source 1..21: mol_type = other RNA
ngaaaagggacagtattctca

SEQ ID NO: 783 - RNA, 21 nt, synthetic construct
  modified_base 1: mod_base = OTHER; note = 2-aminoadenine
  modified_base 2: mod_base = OTHER; note = 2-aminoadenine
  source 1..21: mol_type = other RNA
nnaaaagggacagtattctca

SEQ ID NO: 784 - RNA, 21 nt, synthetic construct
  source 1..21: mol_type = other RNA
cccaataaagctggacaagaa

SEQ ID NO: 785 - RNA, 21 nt, synthetic construct
  modified_base 9: mod_base = i
  source 1..21: mol_type = other RNA
gcttaaaanggacagtattct

SEQ ID NO: 786 - RNA, 21 nt, synthetic construct
  source 1..21: mol_type = other RNA
cttcagttccctgaaagacta

SEQ ID NO: 787 - RNA, 21 nt, synthetic construct
  source 1..21: mol_type = other RNA
gttcagttccctgaaagacta

SEQ ID NO: 788 - RNA, 21 nt, synthetic construct
  modified_base 9: mod_base = i
  source 1..21: mol_type = other RNA
agggtactncttgttgttgca

SEQ ID NO: 789 - RNA, 21 nt, synthetic construct
  source 1..21: mol_type = other RNA
gggacagtattctcagtgatt

SEQ ID NO: 790 - RNA, 21 nt, synthetic construct
  modified_base 1: mod_base = OTHER; note = 2-aminoadenine
  source 1..21: mol_type = other RNA
nagggacagtattctcagtga

SEQ ID NO: 791 - RNA, 21 nt, synthetic construct
  modified_base 18: mod_base = i
  source 1..21: mol_type = other RNA
gagggacagtattctcantga

SEQ ID NO: 792 - RNA, 21 nt, synthetic construct
  modified_base 10: mod_base = i
  source 1..21: mol_type = other RNA
cttcagttcnctgaaagacta

SEQ ID NO: 793 - RNA, 21 nt, synthetic construct
  source 1..21: mol_type = other RNA
cggacagtattctcagtgatt

SEQ ID NO: 794 - RNA, 21 nt, synthetic construct
  modified_base 8: mod_base = i
  source 1..21: mol_type = other RNA
ggcaaagngacagtattctca

SEQ ID NO: 795 - RNA, 21 nt, synthetic construct
  source 1..21: mol_type = other RNA
agggtactccttgttgttgca

SEQ ID NO: 796 - RNA, 21 nt, synthetic construct
  source 1..21: mol_type = other RNA
cttcagttctctgaaagacta

SEQ ID NO: 797 - RNA, 21 nt, synthetic construct
  source 1..21: mol_type = other RNA
cttcagtttcctgaaagacta

SEQ ID NO: 798 - RNA, 21 nt, synthetic construct
  source 1..21: mol_type = other RNA
cgtcagttccctgaaagacta

SEQ ID NO: 799 - RNA, 21 nt, synthetic construct
  source 1..21: mol_type = other RNA
cctcagttccctgaaagacta

SEQ ID NO: 800 - RNA, 21 nt, synthetic construct
  source 1..21: mol_type = other RNA
cgtcagttctctgaaagacta

SEQ ID NO: 801 - RNA, 21 nt, synthetic construct
  source 1..21: mol_type = other RNA
ggtcagttccctgaaagacta

SEQ ID NO: 802 - RNA, 21 nt, synthetic construct
  source 1..21: mol_type = other RNA
gctcagttccctgaaagacta

SEQ ID NO: 803 - RNA, 21 nt, synthetic construct
  source 1..21: mol_type = other RNA
gcctaaaagggacagtattct

SEQ ID NO: 804 - RNA, 21 nt, synthetic construct
  source 1..21: mol_type = other RNA
ccttaaaagggacagtattct

SEQ ID NO: 805 - RNA, 21 nt, synthetic construct
  modified_base 11: mod_base = i
  source 1..21: mol_type = other RNA
gcttaaaaggnacagtattct

SEQ ID NO: 806 - RNA, 21 nt, synthetic construct
  modified_base 9: mod_base = i
  source 1..21: mol_type = other RNA
cttcagttncctgaaagacta

SEQ ID NO: 807 - RNA, 21 nt, synthetic construct
  modified_base 19: mod_base = i
  source 1..21: mol_type = other RNA
agggtactccttgttgttnca

SEQ ID NO: 808 - RNA, 21 nt, synthetic construct
  modified_base 19: mod_base = i
  source 1..21: mol_type = other RNA
cttcagttccctgaaaganta

SEQ ID NO: 809 - RNA, 21 nt, synthetic construct
  modified_base 20: mod_base = i
  source 1..21: mol_type = other RNA
gcttaaaagggacagtattnt

SEQ ID NO: 810 - RNA, 21 nt, synthetic construct
  modified_base 20: mod_base = i
  source 1..21: mol_type = other RNA
ggcaaagggacagtattctna

SEQ ID NO: 811 - RNA, 21 nt, synthetic construct
  modified_base 19: mod_base = i
  source 1..21: mol_type = other RNA
gccaataaagctggacaanaa

SEQ ID NO: 812 - RNA, 21 nt, synthetic construct
  modified_base 10: mod_base = i
  source 1..21: mol_type = other RNA
agggtactcnttgttgttgca

SEQ ID NO: 813 - RNA, 21 nt, synthetic construct
  modified_base 11: mod_base = i
  source 1..21: mol_type = other RNA
cttcagttccntgaaagacta

SEQ ID NO: 814 - RNA, 21 nt, synthetic construct
  modified_base 11: mod_base = i
  source 1..21: mol_type = other RNA
ggcaaaggganagtattctca

SEQ ID NO: 815 - RNA, 21 nt, synthetic construct
  modified_base 9: mod_base = i
  modified_base 20: mod_base = i
  source 1..21: mol_type = other RNA
gagggacantattctcagtna

SEQ ID NO: 816 - RNA, 21 nt, synthetic construct
  modified_base 11: mod_base = i
  source 1..21: mol_type = other RNA
gccaataaagntggacaagaa

SEQ ID NO: 817 - RNA, 21 nt, synthetic construct
  modified_base 10: mod_base = i
  source 1..21: mol_type = other RNA
gcttaaaagngacagtattct

SEQ ID NO: 818 - RNA, 21 nt, synthetic construct
  modified_base 11: mod_base = i
  source 1..21: mol_type = other RNA
gcctaaaaggnacagtattct

SEQ ID NO: 819 - RNA, 21 nt, synthetic construct
  source 1..21: mol_type = other RNA
acctaaaagggacagtattct

SEQ ID NO: 820 - RNA, 21 nt, synthetic construct
  source 1..21: mol_type = other RNA
gcgtaaaagggacagtattct

SEQ ID NO: 821 - RNA, 21 nt, synthetic construct
  source 1..21: mol_type = other RNA
gtctaaaagggacagtattct

SEQ ID NO: 822 - RNA, 21 nt, synthetic construct
  modified_base 18: mod_base = i
  source 1..21: mol_type = other RNA
gggacagtattctcagtnatt

SEQ ID NO: 823 - RNA, 21 nt, synthetic construct
  modified_base 13: mod_base = i
  source 1..21: mol_type = other RNA
gccaataaagctngacaagaa

SEQ ID NO: 824 - RNA, 21 nt, synthetic construct
  modified_base 9: mod_base = i
  source 1..21: mol_type = other RNA
gcttaaaanggacagtattct

SEQ ID NO: 825 - RNA, 21 nt, synthetic construct
  source 1..21: mol_type = other RNA
cagggacagtattctcagtga

SEQ ID NO: 826 - RNA, 21 nt, synthetic construct
  source 1..21: mol_type = other RNA
aggggacagtattctcagtga

SEQ ID NO: 827 - RNA, 21 nt, synthetic construct
  modified_base 20: mod_base = i
  source 1..21: mol_type = other RNA
aggggacagtattctcagtna

SEQ ID NO: 828 - RNA, 21 nt, synthetic construct
  source 1..21: mol_type = other RNA
agaccgccaaggatgcacttt

SEQ ID NO: 829 - RNA, 21 nt, synthetic construct
  modified_base 15: mod_base = i
  source 1..21: mol_type = other RNA
agaccgccaaggatncacttt

SEQ ID NO: 830 - RNA, 21 nt, synthetic construct
  source 1..21: mol_type = other RNA
tcagttccctgaaagactact

SEQ ID NO: 831 - RNA, 21 nt, synthetic construct
  source 1..21: mol_type = other RNA
tcagttccctgaaagactaca

SEQ ID NO: 832 - RNA, 21 nt, synthetic construct
  modified_base 15: mod_base = i
  source 1..21: mol_type = other RNA
actactggagcaccnttaaga

SEQ ID NO: 833 - RNA, 21 nt, synthetic construct
  source 1..21: mol_type = other RNA
cctgtaggttgcttaaaagga

SEQ ID NO: 834 - RNA, 21 nt, synthetic construct
  source 1..21: mol_type = other RNA
gctgtaggttgcttaaaagga

SEQ ID NO: 835 - RNA, 21 nt, synthetic construct
  source 1..21: mol_type = other RNA
ggtcagttctctgaaagacta

SEQ ID NO: 836 - RNA, 21 nt, synthetic construct
  modified_base 14: mod_base = i
  source 1..21: mol_type = other RNA
gccaataaagctgnacaagaa

SEQ ID NO: 837 - RNA, 21 nt, synthetic construct
  modified_base 20: mod_base = i
  source 1..21: mol_type = other RNA
cagggacagtattctcagtna

The invention claimed is:

1. An RNAi agent for inhibiting expression of an APOC3 gene comprising:
    an antisense strand comprising nucleotides 1-21 of SEQ ID NO. 3, SEQ ID NO. 5, SEQ ID NO. 710, or SEQ ID NO. 711;
    a sense strand comprising a nucleotide sequence that is at least partially complementary to the antisense strand;
    wherein the RNAi agent is in a salt form suitable for in vivo delivery to a human subject.

2. The RNAi agent of claim 1, wherein the salt is a sodium salt.

3. The RNAi agent of claim 1, wherein the sense strand comprises one or two inverted abasic residues.

4. The RNAi agent of claim 3, wherein the RNAi agent is conjugated to a targeting ligand that comprises an N-acetyl-galactosamine moiety.

5. The RNAi agent of claim 4, wherein the targeting ligand comprises (NAG37) s.

6. The RNAi agent of claim 5, wherein the sense strand of the RNAi agent is conjugated at the 5' terminal end to (NAG37) s.

7. The RNAi agent of claim 1, wherein the antisense strand comprises the nucleotide sequence of SEQ ID NO: 5.

8. The RNAi agent of claim 7, wherein the sense strand comprises the nucleotide sequence of SEQ ID NO: 18.

9. The RNAi agent of claim 1, wherein the antisense strand comprises the modified nucleotide sequence of usCfsasCfuGfagaauAfcUfgUfcCfcGfsu (SEQ ID NO: 4) (5'→3'), wherein a represents 2'-O-methyl adenosine, c represents 2'-O-methyl cytidine, g represents 2'-O-methyl guanosine, and u represents 2'-O-methyl uridine; Af, represents 2'-fluoro adenosine, Cf represents 2'-fluoro cytidine, Gf represents 2'-fluoro guanosine, and Uf represents 2'-fluoro uridine; s represents a phosphorothioate linkage; and wherein all or substantially all of the nucleotides on the sense strand are modified nucleotides.

10. The RNAi agent of claim 9, wherein the sense strand comprises the modified nucleotide sequence of acgggacaGfUfAfuucucaguia (SEQ ID NO:572) (5'→3'), wherein a represents 2'-O-methyl adenosine, c represents 2'-O-methyl cytidine, g represents 2'-O-methyl guanosine, u represents 2'-O-methyl uridine, and i represents 2'-O-methyl inosine; Af, represents 2'-fluoro adenosine, Cf represents 2'-fluoro cytidine, Gf represents 2'-fluoro guanosine, and Uf represents 2'-fluoro uridine; s represents a phosphorothioate linkage.

11. A composition comprising the RNAi agent of claim 10, wherein the composition comprises a pharmaceutically acceptable excipient.

12. A composition comprising the RNAi agent of claim 9, wherein the composition comprises a pharmaceutically acceptable excipient.

13. The RNAi agent of claim 1, wherein the RNAi agent has the duplex structure of AD05876 (SEQ ID Nos: 4 and 572).

14. A composition comprising the RNAi agent of claim 1, wherein the composition comprises a pharmaceutically acceptable excipient.

15. A method for inhibiting expression of an APOC3 gene in a cell, the method comprising introducing into a cell an effective amount of the RNAi agent of claim 1.

16. The method of claim 15, wherein the cell is within a subject.

17. The method of claim 16, wherein the subject is a human subject.

18. A method of lowering triglyceride levels in a subject, the method comprising administering to the subject an effective amount of a composition of claim 14.

19. A method of lowering low density lipoprotein (LDL) levels in a subject, the method comprising administering to the subject an effective amount of the composition of claim 14.

20. A method of treating an APOC3-related disease or disorder, the method comprising administering to a human subject in need thereof a therapeutically effective amount of the composition of claim 14.

21. The method of claim 20, wherein the disease is a cardiometabolic disease.

22. The method of claim 21, wherein the cardiometabolic disease is hypertriglyceridemia, obesity, hyperlipidemia, abnormal lipid and/or abnormal cholesterol metabolism, atherosclerosis, cardiovascular disease, coronary artery disease, hypertriglyceridemia induced pancreatitis, metabolic syndrome, type II diabetes mellitus, familial chylomicronemia syndrome, or familial partial lipodystrophy.

* * * * *